(12) United States Patent
Bhadra et al.

(10) Patent No.: US 9,909,148 B2
(45) Date of Patent: Mar. 6, 2018

(54) FERMENTATIVE PRODUCTION OF ALCOHOLS

(71) Applicant: BUTAMAX ADVANCED BIOFUELS LLC, Wilmington, DE (US)

(72) Inventors: Bhaskar Bhadra, Secundrabad (IN); Ritu Bhalla, Tirmulgherry (IN); Arthur Leo Kruckeberg, Wilmington, DE (US); Vasantha Nagarajan, Wilmington, DE (US); Ranjan Patnaik, Newark, DE (US); Wonchul Suh, Wilmington, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 286 days.

(21) Appl. No.: 14/368,970

(22) PCT Filed: Dec. 28, 2012

(86) PCT No.: PCT/US2012/072079
§ 371 (c)(1),
(2) Date: Jun. 26, 2014

(87) PCT Pub. No.: WO2013/102084
PCT Pub. Date: Jul. 4, 2013

(65) Prior Publication Data
US 2015/0037855 A1 Feb. 5, 2015

Related U.S. Application Data

(60) Provisional application No. 61/581,877, filed on Dec. 30, 2011, provisional application No. 61/681,230, filed on Aug. 9, 2012.

(30) Foreign Application Priority Data

May 9, 2012 (IN) .......................... 1423/DEL/2012

(51) Int. Cl.
*C12P 7/16* (2006.01)
*C12N 15/81* (2006.01)

(52) U.S. Cl.
CPC ............. *C12P 7/16* (2013.01); *C12N 15/81* (2013.01); *Y02E 50/10* (2013.01); *Y02P 20/582* (2015.11)

(58) Field of Classification Search
None
See application file for complete search history.

(56) References Cited

U.S. PATENT DOCUMENTS

| | | |
|---|---|---|
| 1,891,841 A | 12/1932 | Sak |
| 1,937,672 A | 12/1933 | Sherman |
| 2,016,791 A | 10/1935 | Riley |
| 7,541,173 B2 | 6/2009 | Bramucci et al. |
| 7,659,104 B2 | 2/2010 | Bramucci et al. |
| 7,851,188 B2 | 12/2010 | Donaldson et al. |
| 7,910,342 B2 | 3/2011 | Liao et al. |
| 7,993,889 B1 | 8/2011 | Donaldson et al. |
| 8,017,364 B2 | 9/2011 | Bramucci et al. |
| 8,101,217 B2 | 1/2012 | Sovereign et al. |
| 8,129,162 B2 | 3/2012 | Li et al. |
| 8,178,328 B2 | 5/2012 | Donaldson et al. |
| 8,188,250 B2 | 5/2012 | Bramucci et al. |
| 8,206,970 B2 | 6/2012 | Eliot et al. |
| 8,222,017 B2 | 7/2012 | Li et al. |
| 8,241,878 B2 | 8/2012 | Anthony et al. |
| 8,273,558 B2 | 9/2012 | Donaldson et al. |
| 8,283,144 B2 | 10/2012 | Donaldson et al. |
| 8,372,612 B2 | 2/2013 | Larossa et al. |
| 8,389,252 B2 | 3/2013 | Larossa |
| 8,455,224 B2 | 6/2013 | Paul |
| 8,455,225 B2 | 6/2013 | Bramucci et al. |
| 8,465,964 B2 | 6/2013 | Anthony et al. |
| 8,518,678 B2 | 8/2013 | Flint et al. |
| 8,557,562 B2 | 10/2013 | Bramucci et al. |
| 8,614,085 B2 | 12/2013 | Van Dyk et al. |
| 8,637,281 B2 | 1/2014 | Paul et al. |
| 8,637,289 B2 | 1/2014 | Anthony et al. |
| 8,652,823 B2 | 2/2014 | Flint et al. |
| 8,889,385 B2 | 2/2014 | Donaldson et al. |
| 8,669,094 B2 | 3/2014 | Anthony et al. |
| 8,691,540 B2 | 4/2014 | Bramucci et al. |
| 8,735,114 B2 | 5/2014 | Donaldson et al. |
| 8,765,433 B2 | 7/2014 | Gude et al. |
| 8,785,166 B2 | 7/2014 | Anthony et al. |
| 8,795,992 B2 | 8/2014 | Bramucci et al. |

(Continued)

FOREIGN PATENT DOCUMENTS

| | | |
|---|---|---|
| GB | 294123 | 7/1928 |
| GB | 617502 | 2/1949 |

(Continued)

OTHER PUBLICATIONS

Chica et al. Curr Opin Biotechnol. Aug. 2005;16(4):378-84.*
Sen et al. Appl Biochem Biotechnol. Dec. 2007;143(3):212-23.*
Hsu et al., "Addition of Autotrophic Carbon Fixation Pathways to Increase the Theoretical Heterotrophic Yield of Acetate", The Fourth International Conference on Computational Systems Biology (ISB2010), Suzhou, China, Sep. 9-11, 2010, pp. 314-322.*
Generoso et al. Curr Opin Biotechnol. Jun. 2015;33:1-7.*

(Continued)

*Primary Examiner* — Christian Fronda

(57) ABSTRACT

The invention relates to the fields of industrial microbiology and alcohol production. The invention also relates to the development of a microorganism capable of producing fermentation products via an engineered pathway, and uses of the microorganism. The invention also relates to the methods to improve cell viability and productivity and the use of recycling and acid washing to increase the yield of fermentation products.

21 Claims, 5 Drawing Sheets

(56) References Cited

U.S. PATENT DOCUMENTS

| | | |
|---|---|---|
| 8,828,694 B2 | 9/2014 | Anthony et al. |
| 8,828,704 B2 | 9/2014 | Donaldson et al. |
| 8,871,488 B2 | 10/2014 | Dauner et al. |
| 8,895,307 B2 | 11/2014 | Li et al. |
| 8,906,666 B2 | 12/2014 | Alsaker |
| 8,911,981 B2 | 12/2014 | Li et al. |
| 8,940,511 B2 | 1/2015 | Larossa |
| 8,945,859 B2 | 2/2015 | Donaldson et al. |
| 8,945,899 B2 | 2/2015 | Li et al. |
| 8,951,774 B2 | 2/2015 | Donaldson et al. |
| 8,951,937 B2 | 2/2015 | Flint et al. |
| 8,956,850 B2 | 2/2015 | Anthony et al. |
| 8,962,298 B2 | 2/2015 | Donaldson et al. |
| 8,969,065 B2 | 3/2015 | Anthony et al. |
| 8,980,612 B2 | 3/2015 | Donaldson et al. |
| 9,068,190 B2 | 6/2015 | Donaldson et al. |
| 9,080,179 B2 | 7/2015 | Paul |
| 9,163,266 B2 | 10/2015 | Anthony |
| 9,169,467 B2 | 10/2015 | Govindarajan et al. |
| 9,169,499 B2 | 10/2015 | Paul et al. |
| 9,181,566 B2 | 11/2015 | Dauner et al. |
| 9,206,447 B2 | 12/2015 | Anthony et al. |
| 9,238,801 B2 | 1/2016 | Li et al. |
| 9,238,828 B2 | 1/2016 | McElvain et al. |
| 9,260,708 B2 | 2/2016 | Anthony et al. |
| 9,267,157 B2 | 2/2016 | Anthony et al. |
| 9,273,330 B2 | 3/2016 | Bramucci et al. |
| 9,284,612 B2 | 3/2016 | Liao et al. |
| 9,297,016 B2 | 3/2016 | Flint et al. |
| 9,297,028 B2 | 3/2016 | Donaldson et al. |
| 9,297,029 B2 | 3/2016 | Donaldson et al. |
| 9,303,225 B2 | 4/2016 | Donaldson et al. |
| 9,365,872 B2 | 6/2016 | Donaldson et al. |
| 9,388,392 B2 | 7/2016 | Govindarajan et al. |
| 9,404,117 B2 | 8/2016 | Anthony |
| 9,422,582 B2 | 8/2016 | Anthony et al. |
| 2003/0106437 A1 | 6/2003 | Pajunen et al. |
| 2007/0004022 A1 | 1/2007 | Shen |
| 2007/0092895 A1 | 4/2007 | Puria et al. |
| 2009/0162911 A1 | 6/2009 | Larossa et al. |
| 2009/0305369 A1 | 12/2009 | Donaldson et al. |
| 2010/0081154 A1 | 4/2010 | Flint et al. |
| 2010/0081182 A1 | 4/2010 | Paul et al. |
| 2010/0093020 A1 | 4/2010 | Bramucci et al. |
| 2010/0120105 A1 | 5/2010 | Anthony et al. |
| 2010/0330637 A1 | 12/2010 | Lee |
| 2011/0195505 A1 | 8/2011 | Euler et al. |
| 2011/0207192 A1 | 8/2011 | Pigeau et al. |
| 2011/0244536 A1 | 10/2011 | Nagarajan et al. |
| 2012/0149080 A1 | 6/2012 | Bramucci et al. |
| 2012/0196341 A1 | 8/2012 | Alsaker et al. |
| 2012/0258873 A1 | 10/2012 | Gibson et al. |
| 2013/0035515 A1 | 2/2013 | Dobson et al. |
| 2013/0252296 A1 | 9/2013 | Maggio-Hall et al. |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0038268 A1 | 2/2014 | Flint et al. |
| 2014/0051137 A1 | 2/2014 | Flint et al. |
| 2014/0093930 A1 | 4/2014 | Li et al. |
| 2014/0141479 A1 | 5/2014 | Anthony et al. |
| 2014/0170732 A1 | 6/2014 | Bramucci et al. |
| 2014/0186910 A1 | 7/2014 | Rothman et al. |
| 2014/0186911 A1 | 7/2014 | Anthony et al. |
| 2014/0273116 A1 | 9/2014 | Kelly et al. |
| 2014/0273129 A1 | 9/2014 | Bhalla et al. |
| 2014/0273130 A1 | 9/2014 | Anthony et al. |
| 2014/0349349 A1 | 11/2014 | Dauner et al. |
| 2014/0377824 A1 | 12/2014 | Satagopan et al. |
| 2015/0111269 A1 | 4/2015 | Li et al. |
| 2015/0125920 A1 | 5/2015 | Anthony et al. |
| 2015/0218595 A1 | 8/2015 | Bhadra et al. |
| 2015/0240267 A1 | 8/2015 | Anthony et al. |
| 2016/0024534 A1 | 1/2016 | Anthony et al. |
| 2016/0130612 A1 | 5/2016 | Anthony et al. |
| 2016/0138050 A1 | 5/2016 | Bramucci et al. |
| 2016/0222370 A1 | 8/2016 | Anthony et al. |
| 2016/0319307 A1 | 11/2016 | Nagarajan et al. |

FOREIGN PATENT DOCUMENTS

| | | |
|---|---|---|
| WO | WO200065023 | 11/2000 |
| WO | WO2009026706 | 3/2009 |
| WO | WO2011097711 | 8/2011 |
| WO | WO2011159962 | 12/2011 |
| WO | WO2012122465 | 9/2012 |

OTHER PUBLICATIONS

Yang, et al., Enhanced Acetone-Butanol Fermentation Using Repeated Fed-Batch Operation Coupled with Cell Recycle by Membrane and Simultaneous Removal of Inhibitory Products by Adsorption, Biotechnol. Bioeng. 47:444-450, 1995.

Steen, et al., Metabolic engineering of *Saccharomyces cerevisiae* for the production of n-butanol, Microbial Cell Factories 7:36, 2008

Chen, et al., Increased isobutanol production in *Saccharomyces cerevisiae* by overexpression of genes in valine metabolism, Biotechnology for Biofuels 4:21, 2011.

Ezeji, et al., Acetone butanol ethanol (ABE) production from concentrated substrate: reduction in substrate inhibition by fed-batch technique and product inhibition by gas stripping, Appl. Microbiol. Biotechnol. 63:653-658, 2004.

Atsumi, et al., Metabolic engineering of *Escherichia coli* for 1-butanolproduction, Metab. Eng. 10:305-311, 2008.

Nikawa, et al., Cloning and Characterization of the Low-Affinity Cyclic AMP Phosphodiesterase Gene of *Saccharomyces cerevisiae*, Mol. Cell. Biol. 7:3629-3636, 1987.

Lastauskiene, et al., *Saccharomyces cerevisiae* PDE genes influence medium acidification and cell viability, Biologija 55:24-28, 2009.

Ma, et al., The PDE1-encoded Low-Affinity Phosphodiesterase in the Yeast *Saccharomyces cerevisiae* Has a Specific Function in Controlling Agonist-induced cAMP Signaling, Mol. Biol. Cell 10:91-104, 1999.

Mitsuzavva, Responsiveness to Exogenous cAMP of a *Saccharomyces cerevisiae* Strain Conferred by Naturally Occurring Alleles of PDE1 arid PDE2, Genetics 135:321-326, 1993.

Park, et al., The high-affinity cAMP phosphodiesterase of *Saccharomyces cerevisiae* is the major determinant of cAMP levels in stationary phase: involvement of different branches of the Ras—cyclic AMP pathway in stress responses, Biochem. Biophys. Res. Comm. 327:311-319, 2005.

Thevelein, Fermentable sugars and intracellular acidification as specific activators of the RAS-adenylate cyclase signalling pathway in yeast: the relationship to nutrientinduced cell cycle control, Mol. Microbiol. 5:1301-1307, 1991.

Thevelein et al., Novel sensing mechanisms and targets for the cAMP-protein kinase A pathway in the yeast *Saccharomyces cerevisiae*, Mol. Microbiol. 33:904-918, 1999.

Wera, et al., Glucose exerts opposite ejects on rnRNA versus protein and activity levels of Pde1, the low-affinity cAMP phosphodiesterase from budding yeast, *Saccharomyces cerevisiae*, FEBS Lett. 420:147-150, 1997.

International Search Report for corresponding PCT/US2012/072079, dated Sep. 3, 2013.

International Preliminary Report on Patentability for corresponding PCT/US2012/072079, dated Jul. 10, 2014.

\* cited by examiner

FERMENTATIVE PRODUCTION OF ALCOHOLS

This application claims the benefit of U.S. Provisional Application No. 61/581,877, filed on Dec. 30, 2011; India Patent Application No. 1423/DELNP/2012, filed on May 9, 2012; and U.S. Provisional Application No. 61/681,230, filed on Aug. 9, 2012; the entire contents of which are all herein incorporated by reference.

SEQUENCE LISTING

The sequences provided in the sequence listing filed herewith (CL5196WOPCT_SequenceListing.txt), herein incorporated by reference, conform with 37 C.F.R. §§ 1.821-1.825 ("Requirements for Patent Applications Containing Nucleotide Sequences and/or Amino Acid Sequence Disclosures—the Sequence Rules") and are consistent with the World Intellectual Property Organization (WIPO) Standard ST.25 (2009) and the sequence listing requirements of the EPO and PCT (Rules 5.2 and 49.5($\alpha$-$\beta$is), and Section 208 and Annex C of the Administrative Instructions). The symbols and format used for nucleotide and amino acid sequence data comply with the rules set forth in 37 C.F.R. § 1.822.

FIELD OF THE INVENTION

The invention relates to the fields of industrial microbiology and alcohol production. The invention also relates to the development of a microorganism capable of producing fermentation products via an engineered pathway, and uses of the microorganism. The invention also relates to the methods to improve cell viability and productivity and the use of recycling and acid washing to increase the yield of fermentation products.

BACKGROUND OF THE INVENTION

Butanol is an important industrial chemical useful as a fuel additive, as a feedstock chemical in the plastics industry, and as a food grade extractant in the food and flavor industry. Each year 10 to 12 billion pounds of butanol are produced by chemical syntheses using starting materials derived from petrochemicals. Methods for the chemical synthesis of the butanol isomer isobutanol are known, such as oxo synthesis, catalytic hydrogenation of carbon monoxide (Ullmann's Encyclopedia of Industrial Chemistry, 6th edition, 2003, Wiley-VCH Verlag GmbH and Co., Weinheim, Germany, Vol. 5, pp. 716-719) and Guerbet condensation of methanol with n-propanol (Carlini, et al., J. Molec. Catal. A. Chem. 220:215-220, 2004). These processes use starting materials derived from petrochemicals. The production of isobutanol from plant-derived raw materials could minimize the use of fossil fuels and would represent an advance in the art. Furthermore, production of chemicals and fuels using plant-derived materials or other biomass sources would provide eco-friendly and sustainable alternatives to petrochemical processes.

Isobutanol may be produced biologically as a by-product of yeast fermentation. It is a component of "fusel oil" that forms as a result of the incomplete metabolism of amino acids by this group of fungi. Isobutanol is specifically produced from catabolism of L-valine. After the amine group of L-valine is harvested as a nitrogen source, the resulting $\alpha$-keto acid is decarboxylated and reduced to isobutanol by enzymes of the so-called Ehrlich pathway (Dickinson, et al., J. Biol. Chem. 273:25752-25756, 1998).

Techniques such as genetic engineering and metabolic engineering may be utilized to modify a microorganism to produce a certain product from plant-derived materials or other sources of biomass. The microorganism may be modified, for example, by the insertion of genes such as the insertion of genes encoding a biosynthetic pathway, deletion of genes, or modifications to regulatory elements such as promoters. A microorganism may also be engineered to improve cell productivity and yield, to eliminate by-products of biosynthetic pathways, and/or for strain improvement. Examples of microorganisms expressing engineered biosynthetic pathways for producing butanol isomers, including isobutanol, are described in U.S. Pat. Nos. 7,851,188 and 7,993,889.

However, exposure to alcohols such as ethanol and butanol during fermentation can have a negative impact on cell viability, cell productivity, and product yield. The accumulation of these alcohols can inhibit cell growth and eventually affect the fermentative production of these alcohols. As such, there is a need to develop microorganisms that exhibit improved cell growth and production in the presence of these alcohols as well as methods that maintain and/or improve cell viability and cell productivity.

The present invention is directed to the development of such methods as well as the development of microorganisms capable of producing fermentation products via an engineered pathway in the microorganisms and with improved cell viability and cell productivity and.

SUMMARY OF THE INVENTION

The present invention is directed to a process for producing an alcohol comprising: (a) providing a microorganism, wherein the microorganism produces an alcohol; (b) contacting the microorganism with one or more carbon sources under conditions wherein the alcohol is produced; (c) collecting the microorganism; (d) recovering the alcohol; (e) contacting the collected microorganism of step (c) with one or more carbon sources under conditions wherein the alcohol is produced; (f) repeating steps (c)-(e); and optionally, exposing the microorganism of step (c) to low pH conditions. In some embodiments, steps (c)-(e) are repeated at least 10 times, at least 20 times, at least 30 times, at least 40 times, at least 50 times, at least 100 times, or more times.

The present invention is also directed to a process for producing butanol comprising: (a) providing a butanologen; (b) contacting the butanologen with one or more carbon sources under conditions wherein butanol is produced at an effective yield; (c) collecting the butanologen; (d) recovering the butanol; (e) contacting the collected butanologen of step (c) with one or more carbon sources under conditions wherein butanol is produced at an effective yield and wherein the effective yield is at least about 90% of the effective yield of step (b); (f) repeating steps (c)-(e); and optionally, exposing the collected butanologen of step (c) to low pH conditions. In some embodiments, the collected butanologen of step (c) is exposed to conditions of pH less than or equal to about 2.0 for at least about one hour in the presence of at least about 0.3% butanol. In some embodiments, butanol of step (d) is recovered at a concentration of at least about 6 g/L. In some embodiments, butanol is produced at an effective yield in step (e) which is at least about 99% of the effective yield of step (b). In some embodiments, steps (c)-(e) are repeated at least 10 times, at least 20 times, at least 30 times, at least 40 times, at least 50 times, at least 100 times, or more times.

The present invention is also directed to a method for improving cell viability and productivity comprising (a) collecting a microorganism from an alcohol fermentation; and (b) contacting the microorganism with a nutrient rich medium. The present invention is directed to a method for improving cell viability and productivity comprising (a) collecting a microorganism from an alcohol fermentation; (b) exposing the microorganism to low pH conditions; (c) collecting the microorganism; and (d) contacting the collected microorganism with a nutrient rich medium.

Another process of the invention described herein is a process for producing an alcohol comprising (a) providing a microorganism, wherein the microorganism produces an alcohol; (b) contacting the microorganism with one or more carbon substrates under conditions wherein the alcohol is produced; (c) collecting the microorganism; (d) recovering the alcohol; (e) contacting the microorganism of step (c) with a nutrient rich medium; (f) collecting the microorganism of step (e); (g) contacting the microorganism of step (f) with one or more carbon substrates under conditions wherein the alcohol is produced; and (h) optionally repeating steps (c)-(g).

The present invention is also directed to a process for producing an alcohol comprising (a) providing a microorganism, wherein the microorganism produces an alcohol: (b) contacting the microorganism with one or more carbon substrates under conditions wherein the alcohol is produced; (c) collecting the microorganism; (d) recovering the alcohol; (e) exposing the microorganism of step (c) to low pH conditions; (f) collecting the microorganism from step (e); (g) contacting the microorganism of step (f) with a nutrient rich medium; (h) collecting the microorganism of step (g); (i) contacting the microorganism with one or more carbon substrates under conditions wherein the alcohol is produced; and (j) optionally repeating steps (c)-(i).

In some embodiments of the processes and methods described herein, the step of contacting the microorganism with nutrient rich medium may be conducted under aerobic conditions. In some embodiments of the processes and methods described herein, the pH is less than or equal to about 2. In some embodiments of the processes and methods described herein, the pH conditions may be about 2 to about 4. In some embodiments, the microorganism may be exposed to conditions of pH less than or equal to about 2.0 for at least about one hour.

In some embodiments, the alcohol produced by the methods and processes described herein is methanol, ethanol, propanol, butanol, pentanol, and hexanol. In some embodiments, the butanol may be 1-butanol, 2-butanol, 2-butanone, isobutanol, or mixtures thereof.

In some embodiments, the microorganism may be subjected to cell recycling. In some embodiments, the microorganism may be recycled at least 5 times. In some embodiments, the microorganism may be recycled at least 10 times. In some embodiments, the microorganism may be acid washed during the recycling step. In some embodiments, the microorganism may be acid washed after the recycling step.

In some embodiments of the processes and methods described herein, the step of contacting with the carbon substrate may occur in the presence of an extractant. In some embodiments, the step of contacting with the carbon substrate may occur in anaerobic conditions. In some embodiments, the step of contacting with the carbon substrate may occur in microaerobic conditions. In some embodiments, the step of contacting may be the first contacting. In some embodiments, recycling may occur in anaerobic conditions. In some embodiments, recycling may occur in microaerobic conditions.

In some embodiments, the carbon substrate may be selected from the group consisting of oligosaccharides, polysaccharides, monosaccharides, and mixtures thereof. In some embodiments, the carbon substrate may be selected from the group consisting of fructose, glucose, lactose, maltose, galactose, sucrose, starch, cellulose, feedstocks, ethanol, lactate, succinate, glycerol, corn mash, sugar cane, biomass, a C5 sugar such as xylose and arabinose, and mixtures thereof.

In some embodiments, the microorganism may be a recombinant host cell. In some embodiments, the microorganism may be a butanologen. In some embodiments, the microorganism may be an isobutanologen. In some embodiments, the microorganism may comprise a butanol biosynthetic pathway. In some embodiments, the butanol biosynthetic pathway may be an isobutanol biosynthetic pathway. In some embodiments, the isobutanol biosynthetic pathway may comprise a polynucleotide encoding a polypeptide that catalyzes a substrate to product conversion selected from the group consisting of (a) pyruvate to acetolactate: (b) acetolactate to 2,3-dihydroxyisovalerate; (c) 2,3-dihydroxyisovalerate to 2-ketoisovalerate; (d) 2-ketoisovalerate to isobutyraldehyde; and (e) isobutyraldehyde to isobutanol. In some embodiments, the isobutanol biosynthetic pathway may comprise polynucleotides encoding polypeptides having acetolactate synthase, keto acid reductoisomerase, dihydroxy acid dehydratase, ketoisovalerate decarboxylase, an/or alcohol dehydrogenase activity.

In some embodiments, the butanol biosynthetic pathway may be an isobutanol biosynthetic pathway. In some embodiments, the isobutanol biosynthetic pathway may comprise a polynucleotide encoding a polypeptide that catalyzes a substrate to product conversion selected from the group consisting of: (a) pyruvate to acetolactate; (b) acetolactate to 2,3-dihydroxyisovalerate; (c) 2,3-dihydroxyisovalerate to α-ketoisovalerate: (d) α-ketoisovalerate to isobutyryl-CoA; (e) isobutyryl-CoA to isobutyraldehyde; and (f) isobutyraldehyde to isobutanol. In some embodiments, the isobutanol biosynthetic pathway may comprise polynucleotides encoding polypeptides having acetolactate synthase activity; acetohydroxy acid reductoisomerase activity; acetohydroxy acid dehydratase activity; branched-chain keto acid dehydrogenase activity; aldehyde dehydrogenase activity; and/or branched-chain alcohol dehydrogenase activity.

In some embodiments, the butanol biosynthetic pathway may be a 1-butanol biosynthetic pathway. In some embodiments, the 1-butanol biosynthetic pathway may comprise a polynucleotide encoding a polypeptide that catalyzes a substrate to product conversion selected from the group consisting of: (a) acetyl-CoA to acetoacetyl-CoA; (b) acetoacetyl-CoA to 3-hydroxybutyryl-CoA; (c) 3-hydroxybutyryl-CoA to crotonyl-CoA; (d) crotonyl-CoA to butyryl-CoA; (e) butyryl-CoA to butyraldehyde; and (f) butyraldehyde to 1-butanol. In some embodiments, the 1-butanol biosynthetic pathway may comprise polynucleotides encoding polypeptides having acetyl-CoA acetyltransferase activity; 3-hydroxybutyryl-CoA dehydrogenase activity; crotonase activity; butyryl-CoA dehydrogenase activity; butyraldehyde dehydrogenase activity, and/or butanol dehydrogenase activity.

In some embodiments, the butanol biosynthetic pathway may be a 2-butanol biosynthetic pathway. In some embodiments, the 2-butanol biosynthetic pathway may comprise a polynucleotide encoding a polypeptide that catalyzes a substrate to product conversion selected from the group consisting of: (a) pyruvate to alpha-acetolactate; (b) alpha-acetolactate to acetoin; (c) acetoin to 3-amino-2-butanol; (d) 3-amino-2-butanol to 3-amino-2-butanol phosphate; (e) 3-amino-2-butanol phosphate to 2-butanone; and (f)-butanone to 2-butanol. In some embodiments, the 2-butanol biosynthetic pathway may comprise polynucleotides encoding polypeptides having acetolactate synthase activity; acetolactate decarboxylase activity; acetonin aminase activity; aminobutanol kinase activity; aminobutanol phosphate phosphorylase activity; and/or butanol dehydrogenase activity.

In some embodiments, the 2-butanol biosynthetic pathway may comprise a polynucleotide encoding a polypeptide that catalyzes a substrate to product conversion selected from the group consisting of: (a) pyruvate to alpha-acetolactate; (b) alpha-acetolactate to acetoin; (c) acetoin to 2,3-butanediol; (d) 2,3-butanediol to 2-butanone; and (e) 2-butanone to 2-butanol. In some embodiments, the 2-butanol biosynthetic pathway may comprise polynucleotides encoding polypeptides having acetolactate synthase activity; acetolactate decarboxylase activity; butanediol dehydrogenase activity; dial dehydratase activity; and/or butanol dehydrogenase activity.

In some embodiments, one or more of the substrate to product conversions may utilize NADH or NADPH as a cofactor. In some embodiments, NADH is the cofactor.

In some embodiments, the butanol pathway of the microorganism may comprise at least one polypeptide selected from the group of enzymes having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66, EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.1.36, EC 4.2.1.17, EC 4.2.1.55, EC 1.3.1.44, EC 1.3.1.38, EC 5.4.99.13, EC 4.1.1.5, EC 2.7.1.29, EC 1.1.1.76, EC 1.2.1.57, and EC 4.2.1.28.

In some embodiments, the engineered butanol pathway of the microorganism may comprise at least one polypeptide selected from the following group of enzymes: acetolactate synthase, acetohydroxy acid isomeroreductase, acetohydroxy acid dehydratase, branched-chain alpha-keto acid decarboxylase, branched-chain alcohol dehydrogenase, acylating aldehyde dehydrogenase, branched-chain keto acid dehydrogenase, butyryl-CoA dehydrogenase, butyraldehyde dehydrogenase, transaminase, valine dehydrogenase, valine decarboxylase, omega transaminase, acetyl-CoA acetyltransferase, 3-hydroxybutyryl-CoA dehydrogenase, crotonase, butyryl-CoA dehydrogenase, isobutyryl-CoA mutase, acetolactate decarboxylase, acetonin aminase, butanol dehydrogenase, butyraldehyde dehydrogenase, acetoin kinase, acetoin phosphate aminase, aminobutanol phosphate phospholyase, aminobutanol kinase, butanediol dehydrogenase, and butanediol dehydratase.

In some embodiments, the microorganism or butanologen may comprise one or more modifications that alter expression and/or activity of one or more components of the cAMP signal transduction pathway. In some embodiments, the microorganism or butanologen may comprise one or more modifications that alter expression and/or activity of one or more phosphodiesterases. In some embodiments, the microorganism or butanologen may comprise reduced or eliminated phosphodiesterase and/or phosphodiesterase activity. In some embodiments, the microorganism or butanologen may comprise a modification in a polynucleotide encoding a polypeptide having phosphodiesterase activity. In some embodiments, the microorganism or butanologen may comprise an insertion, deletion, mutation, and/or substitution in an endogenous polynucleotide encoding a polypeptide having phosphodiesterase activity. In some embodiments, the polypeptide having phosphodiesterase activity may correspond to Enzyme Commission Number EC 3.1.4.17. In some embodiments, the polypeptide having phosphodiesterase activity may be PDE1.

In some embodiments, the microorganism or butanologen does not express or has reduced expression of pyruvate decarboxylase. In some embodiments, the reduction in expression is the result of an insertion, deletion, mutation, and/or substitution in a gene encoding pyruvate decarboxylase. In some embodiments, the microorganism or butanologen may comprise a modification in a polynucleotide encoding a polypeptide having pyruvate decarboxylase activity. In some embodiments, the microorganism or butanologen may comprise an insertion, deletion, mutation, and/or substitution in an endogenous polynucleotide encoding a polypeptide having pyruvate decarboxylase activity. In some embodiments, the polypeptide having pyruvate decarboxylase activity may be selected from the group consisting of: PDC1, PDC5, PDC6, and combinations thereof. In some embodiments, the endogenous polynucleotide encoding a polypeptide having pyruvate decarboxylase activity may be selected from the group consisting of: PDC1, PDC5, PDC6, and combinations thereof.

In some embodiments, the microorganism or butanologen does not express or has reduced expression of glyceraldehyde-3-phosphate dehydrogenase. In some embodiments, the reduction in expression is the result of an insertion, deletion, mutation, and/or substitution in a gene encoding glyceraldehyde-3-phosphate dehydrogenase. In some embodiments, the microorganism or butanologen does not express or has reduced expression of BDH1. In some embodiments, the reduction in expression is the result of an insertion, deletion, mutation, and/or substitution in a gene encoding BDH1. In some embodiments, the microorganism or butanologen does not express or has reduced expression of a gene encoding acetolactate reductase. In some embodiments, the reduction in expression is the result of an insertion, deletion, mutation, and/or substitution in a gene encoding YMR226c.

In some embodiments, the microorganism or butanologen may be a yeast cell. In some embodiments, the yeast cell may be a member of a genus of yeast selected from the group consisting of: *Saccharomyces, Schizosaccharomyces, Hansenula, Candida, Kluyveromyces, Yarrowia, Issatchenkia*, and *Pichia*. In some embodiments, the microorganism may be *Saccharomyces cerevisiae*.

The present invention is also directed to compositions comprising a microorganism or butanologen as described herein. In some embodiments, the composition also comprises nutrient rich medium. In some embodiments, the composition may have a pH of less than or equal to about 2. In some embodiments, the composition may have a pH of about 2 to about 4.

DETAILED DESCRIPTION

Figure 1:
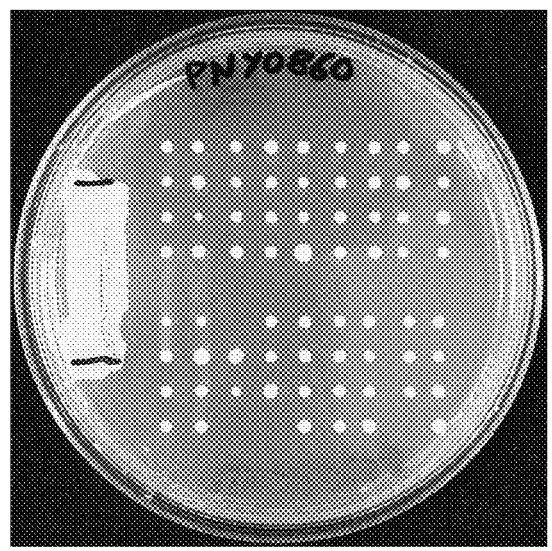
FIG. 1 depicts a tetrad dissection plate for the strain PNY860. Spore viability is as follows: 4+:0−, n=15; 3+:1−, n=2; 2+:2−, n=1; 1+:3−, n=0; 0+:4−, n=0. The vitality and colony size were somewhat variable, but there were no microcolonies.

This invention is directed to microorganisms that produce fermentation products and optimizations for producing fermentation products such as butanol at high rate and titers with advantaged economic process conditions.

During fermentative production of alcohols, microorganisms may be subjected to various stress conditions including, for example, alcohol toxicity, oxidative stress, osmotic stress, and fluctuations in pH, temperature, and nutrient availability. The impact of these stress conditions may cause an inhibition of cell growth and decreased cell viability which can ultimately lead to a reduction in fermentation productivity and product yield. The ability to adapt to these stress conditions by adjusting the metabolic processes of the microorganism is advantageous to maintain efficient alcohol production. For example, when exposed to a particular stressing agent, a microorganism may response to these stress conditions by modifying certain metabolic processes such as growth, signal transduction, transcription, and/or posttranslational activities.

In yeast, the 3'-5'-cyclic adenosine monophosphate (cAMP) signal transduction pathway is a key regulator of cell growth and proliferation, response to nutrient availability, cell cycle progression, metabolism and morphogenesis, cellular defense, and stress responses. Under normal conditions, agonists such as glucose activate adenylate cyclase via G protein-coupled receptor pathways leading to increased levels of cAMP which in turn activates protein kinase A (PKA) (i.e., cAMP binds to the regulatory subunits of PKA) and ultimately results in the inhibition of stress responses mediated, for example, by Msn2p/Msn4p and Yap1p. Under stress conditions, the levels of cAMP are down-regulated via the Ras/cAMP pathway and these lower levels of cAMP lead to a release of the inhibition of the stress responses. Hence, control of cAMP levels is important for cellular stress tolerance in yeast.

The Ras/cAMP pathway is involved in a number of stress responses and thus, is a major determinant of stress resistance in yeast. As an example, the Ras/cAMP pathway is involved in the regulation of cellular responses to osmotic stress, hyperosmotic stress, and freezing and thawing (Park, et al., Biochem. Biophys. Res. Comm. 327:311-319, 2005).

The levels of cAMP are regulated by its synthesis via adenylate cyclase activity and its degradation via hydrolysis by cyclic nucleotide phosphodiesterases (PDE). Two phosphodiesterases, PDE1 and PDE2, have been identified in *Saccharomyces cerevisiae* (Nikawa, et al., Mol. Cell. Biol. 7(10):3629-3636, 1987). PDE1 is a low affinity cAMP phosphodiesterase and PDE2 is a high affinity cAMP phosphodiesterase. It has been shown that PDE1 has a role in the down-regulation of agonist-induced cAMP signaling (e.g., transient, adaptation conditions) by hydrolyzing cAMP which results in the inhibition of PKA. PDE1 activity is regulated by PKA-mediated phosphorylation, that is, phosphorylation of PDE1 by PKA leads to increased phosphodiesterase activity (Ma, et al., Mol. Biol. Cell 10:91-104, 1999). Thus, modulation of cAMP levels and PKA activity by disruption of PDE1 can be an efficient means to control stress tolerance in yeast.

With renewed interest in sustainable biofuels as an alternative energy source and the desire for the development of efficient and environmentally-friendly production methods, alcohol production using fermentation processes is a viable option to the current synthesis processes. However, some microorganisms that produce alcohol (e.g., ethanol, butanol) in certain yields also have low alcohol toxicity thresholds. Thus, the development of fermentation processes for the commercial production of alcohols has been limited by alcohol toxicity. As described above, alcohol toxicity can produce a stress response in the microorganism leading to, for example, an inhibition of cell growth and decreased cell viability.

The present invention is directed to microorganisms with improved cell viability and/or increased alcohol tolerance. In some embodiments, microorganisms may be engineered to exhibit improved cell viability and/or increased alcohol tolerance through one or more modifications that alter expression and/or activity of one or more components of the cAMP signal transduction pathway. In some embodiments, the one or more components of the cAMP signal transduction pathway may be a phosphodiesterase. In some embodiments, the phosphodiesterase may be PDE1.

In some embodiments, the one or more modifications that alter expression and/or activity may be an elimination or reduction in the expression of one or more endogenous genes encoding one or more components of the cAMP signal transduction pathway. In some embodiments, the modification that alters expression and/or activity may be an elimination or reduction in the expression of an endogenous gene encoding a phosphodiesterase. In some embodiments, the modification that alters expression and/or activity may be an elimination or reduction in the expression of an endogenous gene encoding PDE1.

In some embodiments, a microorganism may comprise one or more modifications that alter expression and/or activity of one or more components of the cAMP signal transduction pathway. In some embodiments, a microorganism may comprise one or more modifications that alter expression and/or activity of one or more phosphodiesterases. In some embodiments, a microorganism may comprise one or more modifications that alter expression and/or activity of PDE1.

In some embodiments, a microorganism may comprise one or more modifications that eliminate or reduce the expression of one or more endogenous genes encoding one or more components of the cAMP signal transduction pathway. In some embodiments, a microorganism may comprise one or more modifications that eliminate or reduce the expression of an endogenous gene encoding a phosphodiesterase. In some embodiments, a microorganism may comprise one or more modifications that eliminate or reduce the expression of an endogenous gene encoding PDE1. In some embodiments, a microorganism may comprise one or more modifications that eliminate or reduce the activity of a phosphodiesterase. In some embodiments, a microorganism may comprise one or more modifications that eliminate or reduce the activity PDE1.

In some embodiments, a microorganism may comprise one or more modifications that alter expression and/or activity of one or more components of the cAMP signal transduction pathway and a butanol biosynthetic pathway. In some embodiments, a microorganism may comprise one or more modifications that alter expression and/or activity of one or more phosphodiesterases and a butanol biosynthetic pathway. In some embodiments, a microorganism may comprise one or more modifications that alter expression and/or activity of PDE1 and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, a microorganism may comprise one or more modifications that eliminate or reduce the expression of one or more endogenous genes encoding one or more components of the cAMP signal transduction pathway and a butanol biosynthetic pathway. In some embodiments, a microorganism may comprise one or more modifications that eliminate or reduce the expression of an endogenous gene encoding a phosphodiesterase and a butanol biosynthetic pathway. In some embodiments, a microorganism may comprise one or more modifications that eliminate or reduce the expression of an endogenous gene encoding PDE1 and a butanol biosynthetic pathway. In some embodiments, a microorganism may comprise one or more modifications that eliminate or reduce the activity of a phosphodiesterase and a butanol biosynthetic pathway. In some embodiments, a microorganism may comprise one or more modifications that eliminate or reduce the activity of PDE1 and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

The present invention is directed to compositions comprising a microorganism provided herein. For example, in some embodiments, a composition may comprise a microorganism comprising one or more modifications that alter expression and/or activity of one or more components of the cAMP signal transduction pathway. In some embodiments, a composition may comprise a microorganism comprising one or more modifications that alter expression and/or activity of one or more phosphodiesterases. In some embodiments, a composition may comprise a microorganism comprising one or more modifications that alter expression and/or activity of PDE1.

In some embodiments, a composition may comprise a microorganism comprising one or more modifications that alter expression and/or activity of one or more components of the cAMP signal transduction pathway and a butanol biosynthetic pathway. In some embodiments, a composition may comprise a microorganism comprising one or more modifications that alter expression and/or activity of one or more phosphodiesterases and a butanol biosynthetic pathway. In some embodiments, a composition may comprise a microorganism comprising one or more modifications that alter expression and/or activity of PDE1 and a butanol biosynthetic pathway. In some embodiments, the butanol biosynthetic pathway may be a 1-butanol biosynthetic pathway, 2-butanol biosynthetic pathway, 2-butanone biosynthetic pathway, or isobutanol biosynthetic pathway.

In some embodiments, the microorganism exhibits increased alcohol production as compared to the parent cell. In some embodiments, alcohol production may be determined by measuring, for example: broth titer (grams alcohol produced per liter broth), alcohol yield (grams alcohol produced per gram substrate consumed), volumetric productivity (grams alcohol produced per liter per hour), specific productivity (grams alcohol produced per gram recombinant cell biomass per hour), or combinations thereof.

The present invention is also directed to methods of improving and/or maintaining cell growth and cell viability of a microorganism in an alcohol fermentation. In some embodiments, the method comprises obtaining a microorganism (e.g., parent cell) and introducing one or modifications that alter expression and/or activity of one or more components of the cAMP signal transduction pathway. In some embodiments, the method comprises obtaining a microorganism and introducing one or modifications that eliminate or reduce the expression of one or more endogenous genes encoding one or more components of the cAMP signal transduction pathway. In some embodiments, the method comprises obtaining a microorganism and introducing one or modifications that eliminate or reduce the expression of one or more endogenous genes encoding a phosphodiesterase. In some embodiments, the method comprises obtaining a microorganism and introducing one or modifications that eliminate or reduce the expression of an endogenous gene encoding PDE1. In some embodiments, the method comprises obtaining a microorganism and introducing one or modifications that eliminate or reduce the activity of a phosphodiesterase. In some embodiments, the method comprises obtaining a microorganism and introducing one or modifications that eliminate or reduce the activity of PDE1.

The present invention is also directed to methods of producing an alcohol by a fermentation process. In some embodiments, the method comprises cultivating a microorganism provided herein under conditions whereby the alcohol is produced and recovering the alcohol. In some embodiments, the alcohol may be butanol. In some embodiments, the alcohol may be 1-butanol, 2-butanol, 2-butanone, isobutanol, or tert-butanol.

Microbial contamination can be problematic during the fermentation process. For example, bacteria may be introduced to the fermentation process via the feedstock. As bacteria tend to divide more quickly than yeast, this can lead to significant levels of microbial contamination. In addition, cell recycle may be employed to improve the efficiency of fermentation processes. For example, by re-introducing yeast into the fermentation vessel (or fermentor), the concentration of yeast in the fermentation vessel is continuously maintained at a high level, without a significant diversion of sugars to cell growth and away from production of the desired fermentation product. Cell recycle may be used to increase volumetric conversion rates. Increases in the volumetric rate of conversion of fermentable sugar to butanol can be achieved by continuously separating yeast from the harvested fermentation broth, such as by centrifugation, and then re-circulating the yeast back to the fermentor. However, as a result of such repeated re-circulation of yeast, unwanted microbes, such as bacteria, may also be recycled along with the yeast. These microbial contaminants can compete for nutrients and a depletion of nutrients may suppress yeast cell growth. In addition, microbial contaminants can inhibit yeast metabolism. For example, microbes may produce metabolites that have a negative impact on cell viability and may result in decreased yield of fermentation products.

Control of microbial contamination in fermentation processes may be carried out by acid washing of cell suspensions. One goal of the acid treatment is to destroy contaminating microorganisms that cannot withstand low pH conditions without a substantial reduction in cell viability or fermentative capacity. However, changes in pH conditions can produce a stress response in the microorganism leading to an inhibition of cell growth and decreased cell viability. The present invention is directed to microorganisms with improved cell viability in the presence of low pH conditions as well as methods of producing an alcohol by fermentation processes where the method includes steps of recycling the microorganisms and acid washing of the microorganism suspensions. For example, the method may comprise (a) providing a microorganism, (b) contacting the microorganism with one or more carbon substrates under conditions whereby an alcohol is produced; (c) collecting the microorganism; (d) recovering the alcohol; (e) contacting the collected microorganism with one or more carbon substrates under conditions whereby the alcohol is produced; and (f) exposing the microorganism to low pH conditions. In some embodiments, steps (c)-(e) may be repeated.

A microorganism subjected to acid treatment and/or cell recycling may have a loss of cell viability and productivity. To maintain the cell viability and productivity of the microorganism, the microorganism may be rejuvenated by adding a nutrient rich medium and incubating the microorganism in the nutrient rich medium for a period of time. After the rejuvenation phase, the microorganism may be collected, for example, by centrifugation and resuspended in fresh production medium for continued fermentation.

The present invention is also directed to methods of rejuvenating a microorganism for use in an alcohol fermentation. Following rejuvenation, the microorganism may be recycled to the fermentation process. In some embodiments, the method comprises (a) providing a microorganism, (b) contacting the microorganism with one or more carbon substrates under conditions whereby an alcohol is produced; (c) collecting the microorganism; (d) recovering the alcohol; (e) contacting the microorganism with a nutrient rich medium; (f) collecting the microorganism from step (e); and (g) contacting the microorganism with one or more carbon substrates under conditions whereby the alcohol is produced. In some embodiments, steps (c)-(g) may be repeated. In some embodiments, the first contacting with the carbon substrate occurs in the presence of an extractant. In some embodiments, an extractant may be included, for example, in steps (b) and (g).

In some embodiments, the method comprises (a) providing a microorganism, (b) contacting the microorganism with one or more carbon substrates under conditions whereby an alcohol is produced; (c) collecting the microorganism; (d) exposing the collected microorganism to low pH conditions; (e) collecting the microorganism of step (d); (f) contacting the microorganism of step (e) with a nutrient rich medium; (g) collecting the microorganism of step (f); and (h) contacting the microorganism of step (g) with one or more carbon substrates under conditions whereby the alcohol is produced. In some embodiments, steps (c)-(h) may be repeated. In some embodiments, the method further comprises the step of recovering the alcohol. In some embodiments, the first contacting with the carbon substrate occurs in the presence of an extractant.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents, and other references mentioned herein are incorporated by reference in their entireties for all purposes.

In order to further define this invention, the following terms and definitions are herein provided.

As used herein, the terms "comprises," "comprising," "includes," "including," "has," "having," "contains," or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers may be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure, or composition (see, e.g., M.P.E.P. §2111.03).

Also, the indefinite articles "a" and "an" preceding an element or component of the invention are intended to be nonrestrictive regarding the number of instances, i.e., occurrences of the element or component. Therefore, "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about," the claims include equivalents to the quantities. In one embodiment, the term "about" means within 10% of the reported numerical value, preferably within 5% of the reported numerical value.

In some instances, "biomass" as used herein refers to the cell biomass of the fermentation product-producing microorganism, typically provided in units g/L dry cell weight (dew).

The term "fermentation product" includes any desired product of interest including, but not limited to, alcohols (e.g., lower alkyl alcohols) such as ethanol and butanol, lactic acid, 3-hydroxy-propionic acid, acrylic acid, acetic acid, succinic acid, citric acid, fumaric acid, malic acid, itaconic acid, 1,3-propane-diol, ethylene, glycerol, isobutyrate, etc.

The term "alcohol" refers to any alcohol that can be produced by a microorganism in a fermentation process. Alcohol includes any straight-chain or branched, saturated or unsaturated, alcohol molecule with 1-10 carbon atoms (e.g., lower alkyl alcohols). For example, alcohol includes methanol, ethanol, propanol, butanol, pentanol, and hexanol.

The term "butanol" refers to 1-butanol, 2-butanol, 2-butanone, isobutanol, tert-butanol, or mixtures thereof. Isobutanol is also known as 2-methyl-1-propanol.

The term "butanol biosynthetic pathway" as used herein refers to an enzyme pathway to produce 1-butanol, 2-butanol, 2-butanone, or isobutanol. For example, isobutanol biosynthetic pathways are disclosed in U.S. Patent Application Publication No. 2007/0092957, which is incorporated by reference herein.

The term "isobutanol biosynthetic pathway" refers to the enzymatic pathway to produce isobutanol. From time to time "isobutanol biosynthetic pathway" is used synonymously with "isobutanol production pathway."

The term "1-butanol biosynthetic pathway" as used herein refers to an enzyme pathway to produce 1-butanol.

The term "2-butanol biosynthetic pathway" as used herein refers to an enzyme pathway to produce 2-butanol.

The term "2-butanone biosynthetic pathway" as used herein refers to an enzyme pathway to produce 2-butanone.

The term "extractant" as used herein refers to one or more solvents which may be used to extract an alcohol from a fermentation broth. In some embodiments, the solvent may be an organic solvent.

A "recombinant host cell" is defined as a host cell that has been genetically manipulated to express a biosynthetic production pathway, wherein the host cell either produces a biosynthetic product in greater quantities relative to an unmodified host cell or produces a biosynthetic product that is not ordinarily produced by an unmodified host cell. The term "recombinant microbial host cell" may be used interchangeably with the term recombinant host cell.

The term "fermentable carbon substrate" refers to a carbon source capable of being metabolized by microorganisms such as those disclosed herein. Suitable fermentable carbon substrates include, but are not limited to, monosaccharides, such as glucose or fructose; disaccharides, such as lactose or sucrose; oligosaccharides; polysaccharides, such as starch, cellulose, lignocellulose, or hemicellulose; one-carbon substrates; fatty acids; or combinations thereof.

The term "phosphodiesterase" refers to a polypeptide (or polypeptides) having an enzyme activity that catalyzes the hydrolysis of a phosphodiester bond. For example, phosphodiesterases hydrolyze the cyclic nucleotides, 3'-5'-cyclic adenosine monophosphate (cAMP) and 3'-5'-cyclic guanosine monophosphate (cGMP). The enzymes are known as EC 3.1.4.17 and are available, for example, from *Saccharomyces cerevisiae* (GenBank Nos: CAA64139, CAA96968), *Saccharomyces paradoxus* (Gen Bank ID AABY01000014), *Saccharomyces mikatae* (AABZ01000018, AACH01000636), *Saccharomyces kurdriaizevii* (AACI02000304), *Saccharomyces bayanus* (AACA01000014), *Vanderwaltozyma polyspora* (XM001642700, AAXN01000222, NZ_AAZN01000222), *Zygosaccharomyces rouxii* (NC012994).

The term "fermentation medium" as used herein means a mixture of any of the following: water, sugars (fermentable carbon substrates), dissolved solids, suspended solids, microorganisms producing fermentation products, fermentation product, and all other constituents of the material held in the fermentation vessel in which the fermentation product is being made by the reaction of fermentable carbon substrates to fermentation products, water and carbon dioxide ($CO_2$) by the microorganisms present. From time to time, as used herein the term "fermentation broth" and "fermentation mixture" can be used synonymously with "fermentation medium."

The term "aerobic conditions" as used herein means growth conditions in the presence of oxygen.

The term "microaerobic conditions" as used herein means growth conditions with low levels of dissolved oxygen. For example, the oxygen level may be less than about 1% of air-saturation.

The term "anaerobic conditions" as used herein means growth conditions in the absence of oxygen. It will be understood that in many fermentation processes, an initial amount of oxygen is present at the onset of the process, but such oxygen is depleted over the course of the fermentation such that the majority of the process takes place in the absence of detectable oxygen.

The term "carbon substrate" refers to a carbon source capable of being metabolized by microorganisms disclosed herein. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, and mixtures thereof.

The terms "butanologen" and "isobutanologen" as used herein refer to a microorganism capable of producing butanol or isobutanol, respectively.

The term "sucrose utilizing isobutanologen" as used herein refers to a microorganism capable of producing isobutanol from sucrose. Such microorganisms are typically recombinant microorganisms comprising an engineered isobutanol biosynthetic pathway.

As used herein, the term "yield" refers to the amount of product per amount of carbon source in g/g. The yield may be exemplified for glucose as the carbon source. It is understood unless otherwise noted that yield is expressed as a percentage of the theoretical yield. In reference to a microorganism or metabolic pathway, "theoretical yield" is defined as the maximum amount of product that can be generated per total amount of substrate as dictated by the stoichiometry of the metabolic pathway used to make the product. For example, the theoretical yield for one typical conversion of glucose to isopropanol is 0.33 g/g. As such, a yield of isopropanol from glucose of 29.7 g/g would be expressed as 90% of theoretical or 90% theoretical yield. It is understood that while in the present disclosure the yield is exemplified for glucose as a carbon source, the invention can be applied to other carbon sources and the yield may vary depending on the carbon source used. One skilled in the art can calculate yields on various carbon sources.

The term "effective titer" as used herein, refers to the total amount of alcohol produced by fermentation per liter of fermentation medium. The total amount of alcohol includes: (i) the amount of alcohol in the fermentation medium; (ii) the amount of alcohol recovered from the organic extractant; and (iii) the amount of alcohol recovered from the gas phase, if gas stripping is used.

The term "effective rate" as used herein, refers to the total amount of alcohol produced by fermentation per liter of fermentation medium per hour of fermentation.

The term "effective yield" as used herein, refers to the amount of alcohol produced per unit of fermentable carbon substrate consumed by a microorganism described herein.

The term "specific productivity" as used herein, refers to the g of alcohol produced per g of dry cell weight of cells per unit time.

The terms "derivative" and "analog" refer to a polypeptide differing from the enzymes of the invention, but retaining essential properties thereof. The term "derivative" may also refer to host cells differing from the host cells of the invention, but retaining essential properties thereof. Generally, derivatives and analogs are overall closely similar, and, in many regions, identical to the enzymes of the invention. The terms "derived-from," "derivative," and "analog" when referring to enzymes of the invention include any polypeptides which retain at least some of the activity of the corresponding native polypeptide or the activity of its catalytic domain.

Derivatives of enzymes disclosed herein are polypeptides which may have been altered so as to exhibit features not found on the native polypeptide. Derivatives can be covalently modified by substitution (e.g., amino acid substitution), chemically, enzymatically, or other appropriate means with a moiety other than a naturally occurring amino acid (e.g., a detectable moiety such as an enzyme or radioisotope). Examples of derivatives include fusion proteins, or proteins which are based on a naturally occurring protein sequence, but which have been altered. For example, proteins can be designed by knowledge of a particular amino acid sequence, and/or a particular secondary, tertiary, and/or quaternary structure. Derivatives include proteins that are modified based on the knowledge of a previous sequence, natural or synthetic, which is then optionally modified, often, but not necessarily to confer some improved function. These sequences, or proteins, are then said to be derived from a particular protein or amino acid sequence. In some embodiments of the invention, a derivative may retain at least about 50% identity, at least about 60% identity, at least about 70% identity, at least about 80% identity, at least about 90% identity, at least about 95% identity, at least about 97% identity, or at least about 99% identity to the sequence of the derivative is "derived-from." In some embodiments of the invention, an enzyme is said to be derived-from an enzyme naturally found in a particular species if, using molecular genetic techniques, the DNA sequence for part or all of the enzyme is amplified and placed into a new host cell.

Polypeptides and Polynucleotides

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis. The polypeptides used in this invention comprise full-length polypeptides and fragments thereof.

As used herein, "reduced activity" or "reduced expression" refers to any measurable decrease in a known biological activity or expression of a polypeptide when compared to the same biological activity or expression of the polypeptide prior to the change resulting in the reduced activity or expression. Such a change can include a modification of a polypeptide or a polynucleotide encoding a polypeptide as described herein. Reduced activity or expression of a polypeptide disclosed herein can be determined by methods well known in the art and disclosed herein.

As used herein, "eliminated activity" or "eliminated expression" refers to the abolishment of a known biological activity or expression of a polypeptide when compared to the same biological activity or expression of the polypeptide prior to the change resulting in the eliminated activity or expression. Such a change can include a modification of a polypeptide or a polynucleotide encoding a polypeptide as described herein. Eliminated activity or expression includes biological activity or expression of a polypeptide that is not measurable when compared to the same biological activity or expression of the polypeptide prior to the change resulting in the eliminated activity or expression. Eliminated activity or expression of a polypeptide disclosed herein can be determined by methods well known in the art and disclosed herein.

As used herein, "increased activity" or "increased expression" refers to any measurable increase in a known biological activity or expression of a polypeptide when compared to the same biological activity or expression of the polypeptide prior to the change resulting in the increased activity or expression. Such a change can include a modification of a polypeptide or a polynucleotide encoding a polypeptide as described herein. Increased activity or expression of a polypeptide disclosed herein can be determined by methods well known in the art and disclosed herein.

By an "isolated" polypeptide, or a fragment, variant, or derivative thereof, is intended a polypeptide that is not in its natural milieu. No particular level of purification is required. For example, an isolated polypeptide can be removed from its native or natural environment. Recombinantly produced polypeptides and proteins expressed in host cells are considered isolated for the purposes of the invention, as are native or recombinant polypeptides which have been separated, fractionated, or partially or substantially purified by any suitable technique.

A polypeptide of the invention may be of a size of about 10; 20; 25; 50; 75; 100; 200; 500; 1,000; 2,000; or more amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Also included as polypeptides of the present invention are derivatives, analogs, or variants of the foregoing polypeptides, and any combination thereof. The terms "active variant," "active fragment," "active derivative," and "analog" refer to polypeptides of the present invention. Variants of polypeptides of the present invention include polypeptides with altered amino acid sequences due to amino acid substitutions, deletions, and/or insertions. Variants may occur naturally or be non-naturally occurring. Non-naturally occurring variants may be produced using art-known mutagenesis techniques. Variant polypeptides may comprise conservative or non-conservative amino acid substitutions, deletions, and/or additions. Derivatives of polypeptides of the present invention may be polypeptides which have been altered so as to exhibit additional features not found on the native polypeptide. Examples include fusion proteins. Variant polypeptides may also be referred to herein as "polypeptide analogs." As used herein, a "derivative" of a polypeptide refers to a subject polypeptide having one or more residues chemically derivatized by reaction of a functional side group. Also included as "derivatives" are those peptides which contain one or more naturally occurring amino acid derivatives of the twenty standard amino acids. For example, 4-hydroxyproline may be substituted for proline; 5-hydroxylysine may be substituted for lysine; 3-methylhistidine may be substituted for histidine; homoserine may be substituted for serine; and ornithine may be substituted for lysine.

A "fragment" is a unique portion of a polypeptide or other enzyme used in the invention which is identical in sequence to but shorter in length than the parent full-length sequence. A fragment may comprise up to the entire length of the defined sequence, minus one amino acid residue. For example, a fragment may comprise from about 5 to about 1000 contiguous amino acid residues. A fragment may be at least 5, at least 10, at least 15, at least 20, at least 25, at least 30, at least 40, at least 50, at least 60, at least 75, at least 100, at least 150, at least 250, or at least 500 contiguous amino acid residues in length. Fragments may be preferentially selected from certain regions of a molecule. For example, a polypeptide fragment may comprise a certain length of contiguous amino acids selected from the first 100 or 200 amino acids of a polypeptide as shown in a certain defined sequence. Clearly these lengths are exemplary, and any length that is supported by the specification, including the Sequence Listing, tables, and figures, may be encompassed by the present embodiments.

Alternatively, recombinant variants encoding these same or similar polypeptides may be synthesized or selected by making use of the "redundancy" in the genetic code. Various codon substitutions, such as the silent changes which produce various restriction sites, may be introduced to optimize cloning into a plasmid or viral vector or expression in a host cell system.

Amino acid "substitutions" may be the result of replacing one amino acid with another amino acid having similar structural and/or chemical properties, i.e., conservative amino acid replacements, or they can be result of replacing one amino acid with an amino acid having different structural and/or chemical properties, i.e., non-conservative amino acid replacements. "Conservative" amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" may be in the range of about 1 to about 20 amino acids, more preferably about 1 to about 10 amino acids. The variation allowed may be experimentally determined by systematically making insertions, deletions, or substitutions of amino acids in a polypeptide molecule using recombinant DNA techniques and assaying the resulting recombinant variants for activity.

As used herein, the term "variant" (with respect to a polypeptide) refers to a polypeptide differing from a specifically recited polypeptide of the invention by amino acid insertions, deletions, mutations, and substitutions, created using, for example, recombinant DNA techniques, such as mutagenesis. Guidance in determining which amino acid residues may be replaced, added, or deleted without abolishing activities of interest, may be found by comparing the sequence of the particular polypeptide with that of homologous polypeptides, for example, yeast or bacterial, and minimizing the number of amino acid sequence changes made in regions of high homology (conserved regions) or by replacing amino acids with consensus sequences.

By a polypeptide having an amino acid or polypeptide sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the references sequence.

As a practical matter, whether any particular polypeptide is at least 80%, 85%, 90%, 95%, 96%, 97%, 98%, or 99% identical to a reference polypeptide can be determined conventionally using known computer programs. A preferred method for determining the best overall match between a query sequence (e.g., a sequence of the present invention) and a subject sequence, also referred to as a global sequence alignment, may be determined using the FASTDB computer program based on the algorithm of Brutlag, et al. (Comp. Appl. Biosci. 6:237-245, 1990). In a sequence alignment, the query and subject sequences are either both nucleotide sequences or both amino acid sequences. The result of the global sequence alignment is in percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty-0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case, the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to be made for the purposes of the present invention.

Polypeptides and other enzymes suitable for use in the present invention and fragments thereof are encoded by polynucleotides. The term "polynucleotide" is intended to encompass a singular nucleic acid as well as plural nucleic acids, and refers to an isolated nucleic acid molecule or construct, for example, messenger RNA (mRNA), virally-derived RNA, or plasmid DNA (pDNA). A polynucleotide may comprise a conventional phosphodiester bond or a non-conventional bond (e.g., an amide bond, such as found in peptide nucleic acids (PNA)). A polynucleotide may contain the nucleotide sequence of the full-length cDNA sequence, or a fragment thereof, including the untranslated 5' and 3' sequences and the coding sequences. The polynucleotide can be composed of any polyribonucleotide or polydeoxyribonucleotide, which may be unmodified RNA or DNA or modified RNA or DNA. For example, polynucleotides may be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded, or a mixture of single- and double-stranded regions. "Polynucleotide" embraces chemically, enzymatically, or metabolically modified forms.

The term "nucleic acid" refers to any one or more nucleic acid segments, for example, DNA or RNA fragments, present in a polynucleotide. Polynucleotides according to the present invention further include such molecules produced synthetically. Polynucleotides of the invention may be native to the host cell or heterologous. In addition, a polynucleotide or a nucleic acid may be or may include a regulatory element such as a promoter, ribosome binding site, or a transcription terminator.

In certain embodiments, the polynucleotide or nucleic acid is DNA. In the case of DNA, a polynucleotide comprising a nucleic acid, which encodes a polypeptide normally may include a promoter and/or other transcription or translation control elements operably associated with one or more coding regions. An operable association is when a coding region for a gene product, for example, a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. Other transcription control elements besides a promoter, for example, enhancers, operators, repressors, and transcription termination signals, can be operably associated with the polynucleotide. Suitable promoters and other transcription control regions are described herein and are well known in the art.

A polynucleotide sequence can be referred to as "isolated," it has been removed from its native environment. For example, a heterologous polynucleotide encoding a polypeptide or polypeptide fragment having enzymatic activity (e.g., the ability to convert a substrate to xylulose) contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA may be comprised of one or more segments of cDNA, genomic DNA, or synthetic DNA.

The term "gene" refers to a nucleic acid fragment that is capable of being expressed as a specific protein, optionally including regulatory sequences preceding (5' non-coding sequences) and following (3' non-coding sequences) the coding sequence.

As used herein, a "coding region" or "ORF" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' non-translated regions, and the like, are not part of a coding region. "Suitable regulatory sequences" refer to nucleotide sequences located upstream (5' non-coding sequences), within, or downstream (3' non-coding sequences) of a coding sequence that influence the transcription, RNA processing or stability, or translation of the associated coding sequence. Regulatory sequences may include promoters, translation leader sequences, introns, polyadenylation recognition sequences, RNA processing sites, effector binding sites, and stem-loop structures.

A variety of translation control elements are known to those of ordinary skill in the art. These include, but are not limited to, ribosome binding sites, translation initiation and termination codons, and elements derived from viral systems (particularly an internal ribosome entry site, or IRES). In other embodiments, a polynucleotide of the present invention is RNA, for example, in the form of messenger RNA (mRNA). RNA of the present invention may be single-stranded or double-stranded.

Polynucleotide and nucleic acid coding regions of the present invention may be associated with additional coding regions which encode secretory or signal peptides, which direct the secretion of a polypeptide encoded by a polynucleotide of the present invention.

As used herein, the term "transformation" refers to the transfer of a nucleic acid fragment into the genome of a host organism, resulting in genetically stable inheritance. Host organisms containing the transformed nucleic acid fragments are referred to as "recombinant" or "transformed" organisms.

The term "expression," as used herein, refers to the transcription and stable accumulation of sense (mRNA) or antisense RNA derived from the nucleic acid fragment of the invention. Expression may also refer to translation of mRNA into a polypeptide.

The term "overexpression," as used herein, refers to an increase in the level of nucleic acid or protein in a host cell. Thus, overexpression can result from increasing the level of transcription or translation of an endogenous sequence in a host cell or can result from the introduction of a heterologous sequence into a host cell. Overexpression can also result from increasing the stability of a nucleic acid or protein sequence.

The terms "plasmid," "vector," and "cassette" refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The term "artificial" refers to a synthetic, or non-host cell derived composition, for example, a chemically-synthesized oligonucleotide.

The term, "native" refers to the form of a polynucleotide, gene, or polypeptide as found in nature with its own regulatory sequences, if present.

The term "endogenous," when used in reference to a polynucleotide, a gene, or a polypeptide refers to a native polynucleotide or gene in its natural location in the genome of an organism, or for a native polypeptide, is transcribed and translated from this location in the genome.

The term "heterologous" when used in reference to a polynucleotide, a gene, or a polypeptide refers to a polynucleotide, gene, or polypeptide not normally found in the host organism. "Heterologous polynucleotide" includes a native coding region, or portion thereof, that is reintroduced into the source organism in a form that is different from the corresponding native polynucleotide. "Heterologous gene" includes a native coding region, or portion thereof, that is reintroduced into the source organism in a form that is different from the corresponding native gene, for example, not in its natural location in the organism's genome. For example, a heterologous gene may include a native coding region that is a portion of a chimeric gene including non-native regulatory regions that is reintroduced into the native host. A "transgene" is a gene that has been introduced into the genome by a transformation procedure. "Heterologous polypeptide" includes a native polypeptide that is reintroduced into the source organism in a form that is different from the corresponding native polypeptide. The heterologous polynucleotide or gene may be introduced into the host organism by, for example, gene transfer.

As used herein, the term "modification" refers to a change in a polynucleotide disclosed herein that results in altered activity of a polypeptide encoded by the polynucleotide, as well as a change in a polypeptide disclosed herein that results in altered activity of the polypeptide. Such changes can be made by methods well known in the art, including, but not limited to, deleting, mutating (e.g., spontaneous mutagenesis, random mutagenesis, mutagenesis caused by mutator genes, or transposon mutagenesis), substituting, inserting, altering the cellular location, altering the state of the polynucleotide or polypeptide (e.g., methylation, phosphorylation, or ubiquitination), removing a cofactor, chemical modification, covalent modification, irradiation with UV or X-rays, homologous recombination, mitotic recombination, promoter replacement methods, and/or combinations thereof. Guidance in determining which nucleotides or amino acid residues can be modified, may be found by comparing the sequence of the particular polynucleotide or polypeptide with that of homologous polynucleotides or polypeptides, for example, yeast or bacterial, and maximizing the number of modifications made in regions of high homology (conserved regions) or consensus sequences.

As used herein, the term "variant" (with respect to a polynucleotide) refers to a polynucleotide differing from a specifically recited polynucleotide of the invention by nucleotide insertions, deletions, mutations, and substitutions, created using, for example, recombinant DNA techniques, such as mutagenesis. Recombinant polynucleotide variants encoding same or similar polypeptides may be synthesized or selected by making use of the "redundancy" in the genetic code. Various codon substitutions, such as silent changes which produce various restriction sites, may be introduced to optimize cloning into a plasmid or viral vector for expression. Mutations in the polynucleotide sequence may be reflected in the polypeptide or domains of other peptides added to the polypeptide to modify the properties of any part of the polypeptide.

The term "recombinant genetic expression element" refers to a nucleic acid fragment that expresses one or more specific proteins, including regulatory sequences preceding (5' non-coding sequences) and following (3' termination sequences) coding sequences for the proteins. A chimeric gene is a recombinant genetic expression element. The coding regions of an operon may form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, operators, repressors, transcription termination signals, translation leader sequences, introns, polyadenylation recognition sequences, RNA processing site, effector binding site, and stem-loop structure.

The term "promoter" refers to a nucleic acid sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic nucleic acid segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters." "Inducible promoters," on the other hand, cause a gene to be expressed when the promoter is induced or turned on by a promoter-specific signal or molecule. It is further recognized that since in most cases the exact boundaries of regulatory sequences may not have been completely defined, DNA fragments of different lengths may have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences may not have been completely defined, DNA fragments of different lengths may have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

As used herein the term "transformation" refers to the transfer of a nucleic acid fragment into the genome of a host organism, resulting in genetically stable inheritance. Host organisms containing the transformed nucleic acid fragments are referred to as "transgenic" or "recombinant" or "transformed" organisms.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1 (i.e., Standard Genetic Code). As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

|   | T | C | A | G |
|---|---|---|---|---|
| T | TTT Phe (F)<br>TTC Phe (F)<br>TTA Leu (L)<br>TTG Leu (L) | TCT Ser (S)<br>TCC Ser (S)<br>TCA Ser (S)<br>TCG Ser (S) | TAT Tyr (Y)<br>TAC Tyr (Y)<br>TAA Ter<br>TAG Ter | TGT Cys (C)<br>TGC<br>TGA Ter<br>TGG Trp (W) |
| C | CTT Leu (L)<br>CTC Leu (L)<br>CTA Leu (L)<br>CTG Leu (L) | CCT Pro (P)<br>CCC Pro (P)<br>CCA Pro (P)<br>CCG Pro (P) | CAT His (H)<br>CAC His (H)<br>CAA Gln (Q)<br>CAG Gln (Q) | CGT Arg (R)<br>CGC Arg (R)<br>CGA Arg (R)<br>CGG Arg (R) |
| A | ATT Ile (I)<br>ATC Ile (I)<br>ATA Ile (I)<br>ATG Met (M) | ACT Thr (T)<br>ACC Thr (T)<br>ACA Thr (T)<br>ACG Thr (T) | AAT Asn (N)<br>AAC Asn (N)<br>AAA Lys (K)<br>AAG Lys (K) | AGT Ser (S)<br>AGC Ser (S)<br>AGA Arg (R)<br>AGG Arg (R) |
| G | GTT Val (V)<br>GTC Val (V)<br>GTA Val (V)<br>GTG Val (V) | GCT Ala (A)<br>GCC Ala (A)<br>GCA Ala (A)<br>GCG Ala (A) | GAT Asp (D)<br>GAC Asp (D)<br>GAA Glu (E)<br>GAG Glu (E) | GGT Gly (G)<br>GGC Gly (G)<br>GGA Gly (G)<br>GGG Gly (G) |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes may be tailored for optimal gene expression in a given organism based on codon optimization.

Given the large number of gene sequences available for a wide variety of animal, plant, and microbial species, it is possible to calculate the relative frequencies of codon usage. Codon usage tables are readily available, for example, at the "Codon Usage Database" available at http://wwwv.kazusa.or.jp/codon/, and these tables can be adapted in a number of ways (see, e.g., Nakamura, et al., Nucl. Acids Res. 28:292, 2000). Codon usage tables for yeast, calculated from GenBank Release 128.0 [15 Feb. 2002], are reproduced below as Table 2 (Codon Usage Table for *Saccharomyces cerevisiae* Genes). This table uses mRNA nomenclature, and so instead of thymine (T) which is found in DNA, the tables use uracil (U) which is found in RNA. Table 2 has been adapted so that frequencies are calculated for each amino acid, rather than for all 64 codons.

TABLE 2

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |

TABLE 2-continued

| Amino Acid | Codon | Number | Frequency per thousand |
|---|---|---|---|
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene® Package, available from DNASTAR, Inc., (Madison, Wis.), the backtranslation function in the Vector NTI® Suite, available from InforMax, Inc., (Bethesda, Md.), and the "backtranslate" function in the GCG-Wisconsin Package, available from Accelrys®, Inc., (San Diego, Calif.). In addition, various resources are publicly available to codon-optimize coding region sequences, for example, the "backtranslation" function at http://www.entelechon.com/bioinformatics/backtranslation.php?lang-eng (Entelechon GmbH, Bad Abbach, Germany) and the "backtranseq" function available at http://emboss.bioinformatics.nl/cgi-bin/emboss/backtranseq. Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" at http://www.umbc.edu/codon/sgd/ (University of Maryland, Baltimore County, Baltimore, Md.).

A polynucleotide or nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein. The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see, e.g., Sambrook, et al., supra, 9.50-9.51). For hybridizations with shorter nucleic acids, i.e., oligonucleotides, the position of mismatches becomes more important, and the length of the oligonucleotide determines its specificity (see, e.g., Sambrook, et al., supra, 11.7-11.8). In one embodiment, the length for a hybridizable nucleic acid is at least about 10 nucleotides. Preferably, a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, et al., J. Mol. Biol. 215:403-410, 1993). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as provided herein, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity" as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to, those disclosed in: *Computational Molecular Biology* (Lesk, A. M., Ed.) Oxford University: NY (1988); *Biocomputing: Informatics and Genome Projects* (Smith, D. W., Ed.) Academic: NY (1993); *Computer Analysis of Sequence Data, Part I* (Griffin, A. M., and Griffin, H. G., Eds.) Humania: NJ (1994); *Sequence Analysis in Molecular Biology* (von Heinje, G., Ed.) Academic (1987); and *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the Lasergene® bioinformatics computing suite (DNASTAR, Inc., Madison, Wis.). Multiple alignment of the sequences may be performed using the "Clustal method of alignment" which encompasses several varieties of the algorithm including the "Clustal V method of alignment" corresponding to the alignment method labeled Clustal V (disclosed by Higgins and Sharp, CABIOS. 5:151-153, 1989: Higgins, et al., Comput. Appl. Biosci. 8:189-191, 1992) and found in the MegAlign™ program of the Lasergene® bioinformatics computing suite (DNASTAR, Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5, and DIAGONALS SAVED=5. For nucleic acids, these parameters are KTUPLE=2, GAP PENALTY=5, WINDOW=4, and DIAGONALS SAVED=4. After alignment of the sequences using the Clustal V program, it is possible to obtain a percent identity by viewing the sequence distances table in the same program. Additionally the "Clustal W method of alignment" is available and corresponds to the alignment method labeled Clustal W (described by Higgins and Sharp, CABIOS. 5:151-153, 1989; Higgins, et al., Comput. Appl. Biosci. 8:189-191, 1992) and found in the MegAlign™ v6.1 program of the Lasergene® bioinformatics computing suite (DNASTAR, Inc., Madison, Wis.). Default parameters for multiple alignment may be GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB. After alignment of the sequences using the Clustal W program, it is possible to obtain a percent identity by viewing the sequence distances table in the same program.

The term "sequence analysis software" refers to any computer algorithm or software program that is useful for the analysis of nucleotide or amino acid sequences. Sequence analysis software may be commercially available or independently developed. Typical sequence analysis software may include, but is not limited to: GCG suite of programs (Wisconsin Package Version 9.0, Genetics Computer Group (GCG), Madison, Wis.); BLASTP, BLASTN, BLASTX (Altschul, et al., J. Mol. Biol. 215:403-410, 1990); DNASTAR (DNASTAR, Inc., Madison, Wis.); Sequencher (Gene Codes Corporation, Ann Arbor, Mich.); and FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application, it will be understood that where sequence analysis software is used for analysis, the results of the analysis will be based on the default values of the program referenced, unless otherwise specified. As used herein "default values" will mean any set of values or parameters that originally load with the software when first initialized.

By a nucleic acid or polynucleotide having a nucleotide sequence at least, for example, 95% identical to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence.

As a practical matter, whether any particular nucleic acid molecule or polypeptide is at least 80%, 85%, 90%, 95%, 96%, 97%, 98%, or 99% identical to a nucleotide sequence or polypeptide sequence of the present invention can be determined conventionally using known computer programs. A preferred method for determining the best overall match between a query sequence (e.g., a sequence of the present invention) and a subject sequence, also referred to as a global sequence alignment, can be determined using the FASTDB computer program based on the algorithm of Brutlag, et al., (Comp. Appl. Biosci. 6:237-245, 1990). In a sequence alignment, the query and subject sequences are both DNA sequences. An RNA sequence can be compared by converting uracil (U) to thymine (T). The result of the global sequence alignment is in percent identity. Preferred parameters used in a FASTDB alignment of DNA sequences to calculate percent identity are: Matrix=Unitary, k-tuple=4, Mismatch Penalty=1, Joining Penalty-30, Randomization Group Length=0, Cutoff Score=1, Gap Penalty=5, Gap Size Penalty=0.05, Window Size=500 or the length of the subject nucleotide sequences, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/aligned of the first 10 bases at 5' end. The 10 unpaired bases represent 10% of the sequence (number of bases at the 5' and 3' ends not matched/total number of bases in the query sequence), so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case, the percent identity calculated by FASTDB is not manually corrected. Once again, only bases 5' and 3' of the subject sequence which are not matched/aligned with the query sequence are manually corrected for. No other manual corrections are to be made for the purposes of the present invention.

Standard recombinant DNA and molecular cloning techniques used herein are well known in the art and are described, for example, by Sambrook, J., Fritsch, E. F., and Maniatis, T., *Molecular Cloning: A Laboratory Manual*, Second Edition, Cold Spring Harbor Laboratory Press, Cold Spring Harbor, N.Y. (1989); and by Silhavy, T. J., Bennan, M. L., and Enquist, L. W., *Experiments with Gene Fusions*, Cold Spring Harbor Laboratory Press, Cold Spring Harbor, N.Y. (1984); and by Ausubel, F. M., et al., *Current Protocols in Molecular Biology*, published by Greene Publishing Assoc. and Wiley-Interscience (1987). Additional methods are described in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

Methods for increasing or for reducing gene expression of target genes are well known to one skilled in the art. Methods for gene expression in yeasts are known in the art as described, for example, in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Methods for increasing expression include increasing the number of genes that are integrated in the genome or on plasmids that express the target protein, and using a promoter that is more highly expressed than the natural promoter. Promoters that may be operably linked in a constructed chimeric gene for expression include, for example, constitutive promoters such as FBA1, TDH3, ADH1, and GPM1, and inducible promoters such as GAL1, GAL10, and CUP1. Suitable transcriptional terminators that may be used in a chimeric gene construct for expression include, but are not limited to, FBA1t, TDH3t, GPM1t, ERG10t, GAL10, CYC1t, and ADH1t.

Suitable promoters, transcriptional terminators, and coding regions may be cloned into *Escherichia coli* (*E. coli*)-yeast shuttle vectors, and transformed into yeast cells. These vectors allow for propagation in both *E. coli* and yeast strains. Typically, the vector contains a selectable marker and sequences allowing autonomous replication or chromosomal integration in the desired host. Plasmids used in yeast are, for example, shuttle vectors pRS423, pRS424, pRS425, and pRS426 (American Type Culture Collection, Rockville, Md.), which contain an *E. coli* replication origin (e.g., pMB1), a yeast 2μ origin of replication, and a marker for nutritional selection. The selection markers for these four vectors are HIS3 (vector pRS423), TRP1 (vector pRS424), LEU2 (vector pRS425), and URA3 (vector pRS426). Construction of expression vectors may be performed by either standard molecular cloning techniques in *E. coli* or by the gap repair recombination method in yeast.

Methods for reducing expression include using genetic modification of the encoding genes. Many methods for genetic modification of target genes to reduce or eliminate expression are known to one skilled in the art and may be used to create the production host cells such as yeast. Modifications that may be used include, but are not limited to, deletion of the entire gene or a portion of the gene encoding the protein, inserting a DNA fragment into the encoding gene (e.g., in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less active protein is expressed. In addition, expression of a target gene may be blocked by expression of an antisense RNA or an interfering RNA, and constructs may be introduced that result in cosuppression. In addition, the synthesis or stability of the transcript may be lessened by mutation. Similarly, the efficiency by which a protein is translated from mRNA may be modulated by mutation. All of these methods may be readily practiced by one skilled in the art making use of the known or identified sequences encoding target proteins.

DNA sequences surrounding a target coding sequence are also useful in some modification procedures. In particular, DNA sequences surrounding, for example, a target gene coding sequence are useful for modification methods using homologous recombination. In this method, target gene flanking sequences are placed bounding a selectable marker gene to mediate homologous recombination whereby the marker gene replaces the target gene. Also, partial target gene sequences and target gene flanking sequences bounding a selectable marker gene may be used to mediate homologous recombination whereby the marker gene replaces a portion of the target gene. In addition, the selectable marker may be bounded by site-specific recombination sites, so that following expression of the corresponding site-specific recombinase, the resistance gene is excised from the target gene without reactivating the latter. The site-specific recombination leaves behind a recombination site which disrupts expression of the target protein. The homologous recombination vector may be constructed to also leave a deletion in the target gene following excision of the selectable marker, as is well known to one skilled in the art.

Deletions may be made using mitotic recombination as described in Wach, et al., (Yeast 10:1793-1808, 1994). This method involves preparing a DNA fragment that contains a selectable marker between genomic regions that may be as short as 20 bp, and which binds a target DNA sequence. This DNA fragment can be prepared by PCR amplification of the selectable marker gene using as primers oligonucleotides that hybridize to the ends of the marker gene and that include the genomic regions that can recombine with the yeast genome. The linear DNA fragment can be efficiently transformed into yeast and recombined into the genome resulting in gene replacement including with deletion of the target DNA sequence (as described in Methods in Enzymology, v 194, pp 281-301, 1991).

Moreover, promoter replacement methods may be used to exchange the endogenous transcriptional control elements allowing another means to modulate expression (see, e.g. Mnaimneh, et al., Cell 118:31-44, 2004).

In addition, target gene encoded activity may be disrupted using random mutagenesis, which is followed by screening to identify strains with reduced activity. Using this type of method, the DNA sequence of the target gene encoding region, or any other region of the genome affecting activity, need not be known. Methods for creating genetic mutations are common and well known in the art and may be applied to the exercise of creating mutants. Commonly used random genetic modification methods (reviewed in *Methods in Yeast Genetics,* 2005, Cold Spring Harbor Laboratory Press, Cold Spring Harbor, N.Y.) include spontaneous mutagenesis, mutagenesis caused by mutator genes, chemical mutagenesis, irradiation with UV or X-rays, or transposon mutagenesis.

Chemical mutagenesis of yeast commonly involves treatment of yeast cells with one of the following DNA mutagens: ethyl methanesulfonate (EMS), nitrous acid, diethyl sulfate, or N-methyl-N'-nitro-N-nitroso-guanidine (MNNG). These methods of mutagenesis have been reviewed in Spencer, et al., (Mutagenesis in Yeast, 1996, *Yeast Protocols: Methods in Cell and Molecular Biology*. Humana Press, Totowa, N.J.). Chemical mutagenesis with EMS may be performed as described in *Methods in Yeast Genetics,* 2005, Cold Spring Harbor Laboratory Press, Cold Spring Harbor, N.Y. Irradiation with ultraviolet (UV) light or X-rays can also be used to produce random mutagenesis in yeast cells. The primary effect of mutagenesis by UV irradiation is the formation of pyrimidine dimers which disrupt the fidelity of DNA replication. Protocols for UV-mutagenesis of yeast can be found in Spencer, et al., (Mutagenesis in Yeast, 1996, *Yeast Protocols: Methods in Cell and Molecular Biology*. Humana Press, Totowa, N.J.). Introduction of a mutator phenotype can also be used to generate random chromosomal mutations in yeast. Common mutator phenotypes can be obtained through disruption of one or more of the following genes: PMS1, MAG1, RAD18, or RAD51. Restoration of the non-mutator phenotype can be easily obtained by insertion of the wild-type allele. Collections of modified cells produced from any of these or other known random mutagenesis processes may be screened for reduced activity.

Modification of Phosphodiesterase

In some embodiments of the invention, a microorganism may comprise reduced or eliminated phosphodiesterase activity. In some embodiments, the microorganism may also comprise an isobutanol biosynthetic pathway, a 1-butanol biosynthetic pathway, a 2-butanol biosynthetic pathway, or a 2-butanone biosynthetic pathway as described further herein. In some embodiments, the isobutanol biosynthetic pathway may comprise a polynucleotide encoding a polypeptide that catalyzes a substrate to product conversion selected from the group consisting of: (a) pyruvate to acetolactate; (b) acetolactate to 2,3-dihydroxyisovalerate; (c) 2,3-dihydroxyisovalerate to 2-ketoisovalerate; (d) 2-ketoisovalerate to isobutyraldehyde; and (e) isobutyraldehyde to isobutanol. In some embodiments, the isobutanol biosynthetic pathway may comprise polynucleotides encoding polypeptides having acetolactate synthase activity, keto acid reductoisomerase activity, dihydroxy acid dehydratase activity, ketoisovalerate decarboxylase activity, and alcohol dehydrogenase activity.

In some embodiments, the microorganism may comprise a 1-butanol biosynthetic pathway. In some embodiments, the 1-butanol biosynthetic pathway may comprise a polynucleotide encoding a polypeptide that catalyzes a substrate to product conversion selected from the group consisting of: (a) acetyl-CoA to acetoacetyl-CoA; (b) acetoacetyl-CoA to 3-hydroxybutyryl-CoA; (c) 3-hydroxybutyryl-CoA to crotonyl-CoA; (d) crotonyl-CoA to butyryl-CoA; (e) butyryl-CoA to butyraldehyde; and (f) butyraldehyde to 1-butanol. In some embodiments, the 1-butanol biosynthetic pathway may comprise polynucleotides encoding polypeptides having acetyl-CoA acetyltransferase activity; 3-hydroxybutyryl-CoA dehydrogenase activity; crotonase activity; butyryl-CoA dehydrogenase activity; butyraldehyde dehydrogenase activity, and/or butanol dehydrogenase activity.

In some embodiments, the microorganism may comprise a 2-butanol biosynthetic pathway. In some embodiments, the 2-butanol biosynthetic pathway may comprise a polynucleotide encoding a polypeptide that catalyzes a substrate to product conversion selected from the group consisting of: (a) pyruvate to alpha-acetolactate; (b) alpha-acetolactate to acetoin; (c) acetoin to 3-amino-2-butanol; (d) 3-amino-2-butanol to 3-amino-2-butanol phosphate; (e) 3-amino-2-butanol phosphate to 2-butanone; and (f)-butanone to 2-butanol. In some embodiments, the 2-butanol biosynthetic pathway may comprise polynucleotides encoding polypeptides having acetolactate synthase activity; acetolactate decarboxylase activity; acetonin aminase activity; aminobutanol kinase activity; aminobutanol phosphate phosphorylase activity; and/or butanol dehydrogenase activity.

In some embodiments, the 2-butanol biosynthetic pathway may comprise a polynucleotide encoding a polypeptide that catalyzes a substrate to product conversion selected from the group consisting of: (a) pyruvate to alpha-acetolactate; (b) alpha-acetolactate to acetoin; (c) acetoin to 2,3-butanediol; (d) 2,3-butanediol to 2-butanone; and (e) 2-butanone to 2-butanol. In some embodiments, the 2-butanol biosynthetic pathway may comprise polynucleotides encoding polypeptides having acetolactate synthase activity; acetolactate decarboxylase activity; butanediol dehydrogenase activity: dial dehydratase activity; and/or butanol dehydrogenase activity.

In some embodiments of the invention, a microorganism may comprise a modification or disruption of a polynucleotide or gene encoding a polypeptide having phosphodiesterase activity or a modification or disruption of a polypeptide having phosphodiesterase activity. In some embodiments, the microorganism may comprise an insertion, deletion, mutation, and/or substitution in an endogenous polynucleotide or gene encoding a polypeptide having phosphodiesterase activity or in an endogenous polypeptide having phosphodiesterase activity. Such modifications, disruptions, insertions, deletions, mutations, and/or substitutions may result in phosphodiesterase activity that is reduced or eliminated. In still other embodiments, a polynucleotide, gene, or polypeptide having phosphodiesterase activity may correspond to Enzyme Commission Number EC 3.1.4.17.

Examples of phosphodiesterase polynucleotides, genes, and polypeptides that can be targeted for modification or inactivation in a microorganism disclosed herein include, but are not limited to, SEQ ID NOs: 1-3.

Other examples of phosphodiesterase polynucleotides, genes, and polypeptides that may be targeted for modification or inactivation in a microorganism disclosed herein include, but are not limited to, phosphodiesterase polynucleotides, genes, and/or polypeptides having at least about 70% to about 75%, about 75% to about 80%, about 80% to about 85%, about 85% to about 90%, about 90% to about 95%, about 96%, about 97%, about 98%, or about 99% sequence identity to SEQ ID NOs: 1-3, wherein such a polynucleotide or gene encodes, or such a polypeptide has, phosphodiesterase activity. Still other examples of phosphodiesterase polynucleotides, genes, and polypeptides that may be targeted for modification or inactivation in a microorganism disclosed herein include, but are not limited to an active variant, fragment, or derivative of SEQ ID NOs: 1-3, wherein such a polynucleotide or gene encodes, or such a polypeptide has, phosphodiesterase activity.

In some embodiments, the sequences of other phosphodiesterase polynucleotides, genes, and/or polypeptides may be identified in the literature and/or in bioinformatics databases well known to the skilled person using sequences disclosed herein and available in the art. For example, such sequences may be identified through BLAST searching of publicly available databases with known phosphodiesterase-encoding polynucleotide or polypeptide sequences. In such a method, identities may be based on the Clustal W method of alignment using the default parameters of GAP PENALTY=10, GAP LENGTH PENALTY=0.1, and Gonnet 250 series of protein weight matrix.

Additionally, the phosphodiesterase polynucleotide or polypeptide sequences disclosed herein or known the art may be used to identify other phosphodiesterase homologs in nature. For example, the phosphodiesterase encoding nucleic acid fragments disclosed herein may be used to isolate genes encoding homologous proteins. Isolation of homologous genes using sequence-dependent protocols is well known in the art. Examples of sequence-dependent protocols include, but are not limited to methods of nucleic acid hybridization; methods of DNA and RNA amplification, as exemplified by various uses of nucleic acid amplification technologies [e.g., polymerase chain reaction (PCR), U.S. Pat. No. 4,683,202; ligase chain reaction (LCR), Tabor, et al., Proc. Acad. Sci. U.S.A. 82:1074, 1985; or strand displacement amplification (SDA), Walker, et al., Proc. Natl. Acad. Sci. U.S.A., 89:392, 1992]; and methods of library construction and screening by complementation.

In some embodiments, phosphodiesterase polynucleotides, genes, and/or polypeptides related to a microorganism disclosed herein may be modified or disrupted. Many methods for genetic modification and disruption of target genes to reduce or eliminate expression are known to one of ordinary skill in the art and may be used to create a microorganism disclosed herein. Modifications that can be used include, but are not limited to, deletion of the entire gene or a portion of the gene encoding a phosphodiesterase polypeptide, inserting a DNA fragment into the encoding gene (in either the promoter or coding region) so that the protein is not expressed or expressed at lower levels, introducing a mutation into the coding region which adds a stop codon or frame shift such that a functional protein is not expressed, and/or introducing one or more mutations into the coding region to alter amino acids so that a nonfunctional or a less active protein is expressed. In some embodiments, expression of a target gene may be blocked by expression of an antisense RNA or an interfering RNA, and constructs can be introduced that result in cosuppression. In some embodiments, the synthesis or stability of the transcript may be lessened by mutation. In some embodiments, the efficiency by which a protein is translated from mRNA may be modulated by mutation. These methods may be readily practiced by one skilled in the art making use of the known or identified sequences encoding target proteins.

The modification of phosphodiesterase in a microorganism disclosed herein to reduce or eliminate phosphodiesterase activity may be confirmed using methods known in the art. For example, disruption of a particular phosphodiesterase may be confirmed with PCR screening using primers internal and external to the phosphodiesterase gene or by Southern blot using a probe designed to the phosphodiesterase gene sequence. Alternatively, one could utilize enzyme assay methods to measure phosphodiesterase activity (e.g., Bridge-It® PDE assays, Mediomics, LLC, St. Louis, Mo.; PDE-Glo™ Phosphodiesterase assay, Promega, Madison, Wis.; Younes, et al., Anal. Biochem. 417:36-40, 2011).

Biosynthetic Pathways

Biosynthetic pathways for the production of isobutanol that may be used include those described in U.S. Pat. No. 7,851,188, which is incorporated herein by reference. In one embodiment, the isobutanol biosynthetic pathway may comprise the following substrate to product conversions:
  a) pyruvate to acetolactate, which may be catalyzed, for example, by acetolactate synthase;
  b) acetolactate to 2,3-dihydroxyisovalerate, which may be catalyzed, for example, by acetohydroxy acid reductoisomerase;
  c) 2,3-dihydroxyisovalerate to α-ketoisovalerate, which may be catalyzed, for example, by acetohydroxy acid dehydratase;
  d) α-ketoisovalerate to isobutyraldehyde, which may be catalyzed, for example, by a branched-chain α-keto acid decarboxylase; and,
  e) isobutyraldehyde to isobutanol, which may be catalyzed, for example, by a branched-chain alcohol dehydrogenase.

In another embodiment, the isobutanol biosynthetic pathway may comprise the following substrate to product conversions:
  a) pyruvate to acetolactate, which may be catalyzed, for example, by acetolactate synthase;
  b) acetolactate to 2,3-dihydroxyisovalerate, which may be catalyzed, for example, by ketol-acid reductoisomerase;
  c) 2,3-dihydroxyisovalerate to a-ketoisovalerate, which may be catalyzed, for example, by dihydroxyacid dehydratase;
  d) α-ketoisovalerate to valine, which may be catalyzed, for example, by transaminase or valine dehydrogenase;
  e) valine to isobutylamine, which may be catalyzed, for example, by valine decarboxylase;
  f) isobutylamine to isobutyraldehyde, which may be catalyzed by, for example, omega transaminase; and,
  g) isobutyraldehyde to isobutanol, which may be catalyzed, for example, by a branched-chain alcohol dehydrogenase.

In another embodiment, the isobutanol biosynthetic pathway may comprise the following substrate to product conversions:
  a) pyruvate to acetolactate, which may be catalyzed, for example, by acetolactate synthase;
  b) acetolactate to 2,3-dihydroxyisovalerate, which may be catalyzed, for example, by acetohydroxy acid reductoisomerase;
  c) 2,3-dihydroxyisovalerate to α-ketoisovalerate, which may be catalyzed, for example, by acetohydroxy acid dehydratase;
  d) α-ketoisovalerate to isobutyryl-CoA, which may be catalyzed, for example, by branched-chain keto acid dehydrogenase;
  e) isobutyryl-CoA to isobutyraldehyde, which may be catalyzed, for example, by acetylating aldehyde dehydrogenase; and,
  f) isobutyraldehyde to isobutanol, which may be catalyzed, for example, by a branched-chain alcohol dehydrogenase.

Biosynthetic pathways for the production of 1-butanol that may be used include those described in U.S. Patent Application Publication No. 2008/0182308, which is incorporated herein by reference. In one embodiment, the 1-butanol biosynthetic pathway may comprise the following substrate to product conversions:
  a) acetyl-CoA to acetoacetyl-CoA, which may be catalyzed, for example, by acetyl-CoA acetyltransferase;
  b) acetoacetyl-CoA to 3-hydroxybutyryl-CoA, which may be catalyzed, for example, by 3-hydroxybutyryl-CoA dehydrogenase;
  c) 3-hydroxybutyryl-CoA to crotonyl-CoA, which may be catalyzed, for example, by crotonase;
  d) crotonyl-CoA to butyryl-CoA, which may be catalyzed, for example, by butyryl-CoA dehydrogenase;
  e) butyryl-CoA to butyraldehyde, which may be catalyzed, for example, by butyraldehyde dehydrogenase; and,
  f) butyraldehyde to 1-butanol, which may be catalyzed, for example, by butanol dehydrogenase.

Biosynthetic pathways for the production of 2-butanol that may be used include those described in U.S. Patent Application Publication No. 2007/0259410 and U.S. Patent Application Publication No. 2009/0155870, which are incorporated herein by reference. In one embodiment, the 2-butanol biosynthetic pathway may comprise the following substrate to product conversions:
  a) pyruvate to alpha-acetolactate, which may be catalyzed, for example, by acetolactate synthase;
  b) alpha-acetolactate to acetoin, which may be catalyzed, for example, by acetolactate decarboxylase;
  c) acetoin to 3-amino-2-butanol, which may be catalyzed, for example, acetonin aminase;
  d) 3-amino-2-butanol to 3-amino-2-butanol phosphate, which may be catalyzed, for example, by aminobutanol kinase;
  e) 3-amino-2-butanol phosphate to 2-butanone, which may be catalyzed, for example, by aminobutanol phosphate phosphorylase; and,
  f) 2-butanone to 2-butanol, which may be catalyzed, for example, by butanol dehydrogenase.

In another embodiment, the 2-butanol biosynthetic pathway may comprise the following substrate to product conversions:
  a) pyruvate to alpha-acetolactate, which may be catalyzed, for example, by acetolactate synthase;
  b) alpha-acetolactate to acetoin, which may be catalyzed, for example, by acetolactate decarboxylase;
  c) acetoin to 2,3-butanediol, which may be catalyzed, for example, by butanediol dehydrogenase;
  d) 2,3-butanediol to 2-butanone, which may be catalyzed, for example, by dial dehydratase; and,
  e) 2-butanone to 2-butanol, which may be catalyzed, for example, by butanol dehydrogenase.

Biosynthetic pathways for the production of 2-butanone that may be used include those described in U.S. Patent Application Publication No. 2007/0259410 and U.S. Patent Application Publication No. 2009/0155870, which are incorporated herein by reference. In one embodiment, the 2-butanone biosynthetic pathway may comprise the following substrate to product conversions:

a) pyruvate to alpha-acetolactate, which may be catalyzed, for example, by acetolactate synthase;
b) alpha-acetolactate to acetoin, which may be catalyzed, for example, by acetolactate decarboxylase;
c) acetoin to 3-amino-2-butanol, which may be catalyzed, for example, acetonin aminase;
d) 3-amino-2-butanol to 3-amino-2-butanol phosphate, which may be catalyzed, for example, by aminobutanol kinase; and,
e) 3-amino-2-butanol phosphate to 2-butanone, which may be catalyzed, for example, by aminobutanol phosphate phosphorylase.

In another embodiment, the 2-butanone biosynthetic pathway may comprise the following substrate to product conversions:

a) pyruvate to alpha-acetolactate, which may be catalyzed, for example, by acetolactate synthase;
b) alpha-acetolactate to acetoin which may be catalyzed, for example, by acetolactate decarboxylase;
c) acetoin to 2,3-butanediol, which may be catalyzed, for example, by butanediol dehydrogenase;
d) 2,3-butanediol to 2-butanone, which may be catalyzed, for example, by diol dehydratase.

In some embodiments, the methods described herein may produce butanol from plant-derived carbon sources, avoiding the negative environmental impact associated with standard petrochemical processes for butanol production. In some embodiments, the methods for the production of butanol utilize recombinant host cells comprising a butanol pathway. In some embodiments, the butanol biosynthetic pathways may comprise at least one polynucleotide, at least two polynucleotides, at least three polynucleotides, or at least four polynucleotides that is/are heterologous to the recombinant host cell. In some embodiments, each substrate to product conversion of a butanol biosynthetic pathway in a recombinant host cell is catalyzed by a heterologous polypeptide. In some embodiments, the polypeptide catalyzing the substrate to product conversions of acetolactate to 2,3-dihydroxyisovalerate and/or the polypeptide catalyzing the substrate to product conversion of isobutyraldehyde to isobutanol are capable of utilizing nicotinamide adenine dinucleotide, reduced (NADH) as a cofactor.

The terms "acetohydroxyacid synthase," "acetolactate synthase," and "acetolactate synthetase" (abbreviated "ALS") are used interchangeably herein to refer to a polypeptide (or polypeptides) having an enzyme activity that catalyzes the conversion of pyruvate to acetolactate and $CO_2$. Example acetolactate synthases are known by the EC number 2.2.1.6 (Enzyme Nomenclature 1992, Academic Press, San Diego). These unmodified enzymes are available from a number of sources, including, but not limited to, *Bacillus subtilis* (GenBank Nos: CAB15618 (SEQ ID NO: 4), Z99122 (SEQ ID NO: 5), CAB07802 (SEQ ID NO: 272), *Klebsiella pneumoniae* (GenBank Nos: AAA25079 (SEQ ID NO: 6), M73842 (SEQ ID NO: 7)), and *Lactococcus lactis* (GenBank Nos: AAA25161 (SEQ ID NO: 8), L16975 (SEQ ID NO: 9)).

The term "ketol-acid reductoisomerase" ("KARI"), "acetohydroxy acid isomeroreductase," and "acetohydroxy acid reductoisomerase" are used interchangeably and refer to a polypeptide (or polypeptides) having an enzyme activity capable of catalyzing the reaction of (S)-acetolactate to 2,3-dihydroxyisovalerate. Example KARI enzymes may be classified as EC number EC 1.1.1.86 (Enzyme Nomenclature 1992, Academic Press, San Diego), and are available from a vast array of microorganisms, including, but not limited to, *E. coli* (GenBank Nos: NP_418222 (SEQ ID NO: 10), NC_000913 (SEQ ID NO: 11)), *Saccharomyces cerevisiae* (GenBank Nos: NP_013459 (SEQ ID NO: 12), NC_001144 (SEQ ID NO: 13)), *Methanococcus maripaludis* (GenBank Nos: CAF30210 (SEQ ID NO: 14), BX957220 (SEQ ID NO: 15)), and *Bacillus subtilis* (GenBank Nos: CAB14789 (SEQ ID NO: 16), Z99118 (SEQ ID NO: 17)). KARIs include *Anaerostipes caccae* KARI variants "K9G9" and "K9D3" (SEQ ID NOs: 18 and 19, respectively). Ketol-acid reductoisomerase enzymes are described in U.S. Patent Application Publication Nos. 2008/0261230, 2009/0163376, and 2010/0197519, and PCT Application Publication No. WO/2011/041415, which are incorporated herein by reference. Examples of KARIs disclosed therein are those from *Lactococcus lactis*, *Vibrio cholera*, *Pseudomonas aeruginosa* PAO1, and *Pseudomonas fluorescens* PF5 mutants. In some embodiments, the KARI utilizes NADH. In some embodiments, the KARI utilizes nicotinamide adenine dinucleotide phosphate, reduced (NADPH).

The term "acetohydroxy acid dehydratase" and "dihydroxyacid dehydratase" ("DHAD") refers to a polypeptide (or polypeptides) having an enzyme activity that catalyzes the conversion of 2,3-dihydroxyisovalerate to α-ketoisovalerate. Example acetohydroxy acid dehydratases are known by the EC number 4.2.1.9. Such enzymes are available from a vast array of microorganisms, including, but not limited to, *E. coli* (GenBank Nos: YP_026248 (SEQ ID NO: 20), NC000913 (SEQ ID NO: 21)), *Saccharomyces cerevisiae* (GenBank Nos: NP_012550 (SEQ ID NO: 22), NC 001142 (SEQ ID NO: 23)), *M. maripaludis* (GenBank Nos: CAF29874 (SEQ ID NO: 24), BX957219 (SEQ ID NO: 25)), *Bacillus subtilis* (GenBank Nos: CAB14105 (SEQ ID NO: 26), Z99115 (SEQ ID NO: 27)), *L. lactis*, and *N. crassa*. U.S. Patent Application Publication No. 2010/0081154, and U.S. Pat. No. 7,851,188, which are incorporated herein by reference, describe dihydroxyacid dehydratases (DHADs), including a DHAD from *Streptococcus mutans*.

The term "branched-chain α-keto acid decarboxylase," "α-ketoacid decarboxylase," "α-ketoisovalerate decarboxylase," or "2-ketoisovalerate decarboxylase" ("KIVD") refers to a polypeptide (or polypeptides) having an enzyme activity that catalyzes the conversion of α-ketoisovalerate to isobutyraldehyde and $CO_2$. Example branched-chain α-keto acid decarboxylases are known by the EC number 4.1.1.72 and are available from a number of sources, including, but not limited to, *Lactococcus lactis* (GenBank Nos: AAS49166 (SEQ ID NO: 28), AY548760 (SEQ ID NO: 29); CAG34226 (SEQ ID NO: 30), AJ746364 (SEQ ID NO: 31), *Salmonella typhimurium* (GenBank Nos: NP_461346 (SEQ ID NO: 32), NC_003197 (SEQ ID NO: 33)), *Clostridium acetobutilicum* (GenBank Nos: NP_149189 (SEQ ID NO: 34), NC_001988 (SEQ ID NO: 35)), *M. caseolyticus* (SEQ ID NO: 36), and *L. grayi* (SEQ ID NO: 37).

The term "branched-chain alcohol dehydrogenase" ("ADH") refers to a polypeptide (or polypeptides) having an enzyme activity that catalyzes the conversion of isobutyraldehyde to isobutanol. Example branched-chain alcohol dehydrogenases are known by the EC number 1.1.1.265, but may also be classified under other alcohol dehydrogenases (specifically, EC 1.1.1.1 or 1.1.1.2). Alcohol dehydrogenases may be NADPH-dependent or NADH-dependent. Such enzymes are available from a number of sources, including, but not limited to, *Saccharomyces cerevisiae* (GenBank Nos: NP_010656 (SEQ ID NO: 38), NC_001136 (SEQ ID NO: 39), NP_014051 (SEQ ID NO: 40), NC_001145 (SEQ ID NO: 41)), *E. coli* (GenBank Nos: NP_417484 (SEQ ID NO: 42), NC_000913 (SEQ ID NO: 43)), *Clostridium acetobutylicum* (GenBank Nos: NP_349892 (SEQ ID NO: 44), NC_003030 (SEQ ID NO: 45); NP_349891 (SEQ ID NO: 46), NC_003030 (SEQ ID NO: 47)). U.S. Patent Application Publication No. 2009/0269823 describes SadB, an alcohol dehydrogenase (ADH) from *Achromobacter xylosoxidans*. Alcohol dehydrogenases also include horse liver ADH and *Beijerinkia indica* ADH (as described by U.S. Patent Application Publication No. 2011/0269199, which is incorporated herein by reference).

The term "butanol dehydrogenase" refers to a polypeptide (or polypeptides) having an enzyme activity that catalyzes the conversion of isobutyraldehyde to isobutanol or the conversion of 2-butanone and 2-butanol. Butanol dehydrogenases are a subset of a broad family of alcohol dehydrogenases. Butanol dehydrogenase may be NAD- or NADP-dependent. The NAD-dependent enzymes are known as EC 1.1.1.1 and are available, for example, from *Rhodococcus ruber* (GenBank Nos: CAD36475, AJ491307). The NADP-dependent enzymes are known as EC 1.1.1.2 and are available, for example, from *Pyrococcus furiosus* (GenBank Nos: AAC25556, AF013169). Additionally, a butanol dehydrogenase is available from *E. coli* (GenBank Nos: NP 417484, NC_000913) and a cyclohexanol dehydrogenase is available from *Acinetobacter* sp. (GenBank Nos: AAG10026, AF282240). The term "butanol dehydrogenase" also refers to an enzyme that catalyzes the conversion of butyraldehyde to 1-butanol, using either NADH or NADPH as cofactor. Butanol dehydrogenases are available from, for example, *Clostridium acetobutylicum* (GenBank Nos: NP_149325, NC_001988; note: this enzyme possesses both aldehyde and alcohol dehydrogenase activity; NP_349891, NC_003030, NP_349892, NC_003030) and *E. coli* (GenBank Nos: NP_417-484, NC_000913).

The term "branched-chain keto acid dehydrogenase" refers to a polypeptide (or polypeptides) having an enzyme activity that catalyzes the conversion of α-ketoisovalerate to isobutyryl-CoA (isobutyryl-coenzyme A), typically using NAD$^+$ (nicotinamide adenine dinucleotide) as an electron acceptor. Example branched-chain keto acid dehydrogenases are known by the EC number 1.2.4.4. Such branched-chain keto acid dehydrogenases are comprised of four subunits and sequences from all subunits are available from a vast array of microorganisms, including, but not limited to, *Bacillus subtilis* (GenBank Nos: CAB14336 (SEQ ID NO: 48), Z99116 (SEQ ID NO: 49); CAB14335 (SEQ ID NO: 50), Z99116 (SEQ ID NO: 51); CAB14334 (SEQ ID NO: 52), Z99116 (SEQ ID NO: 53); and CAB 14337 (SEQ ID NO: 54), Z99116 (SEQ ID NO: 55)) and *Pseudomonas putida* (GenBank Nos: AAA65614 (SEQ ID NO: 56), M57613 (SEQ ID NO: 57); AAA65615 (SEQ ID NO: 58), M57613 (SEQ ID NO: 59); AAA65617 (SEQ ID NO: 60), M57613 (SEQ ID NO: 61); and AAA65618 (SEQ ID NO: 62), M57613 (SEQ ID NO: 63)).

The term "acylating aldehyde dehydrogenase" refers to a polypeptide (or polypeptides) having an enzyme activity that catalyzes the conversion of isobutyryl-CoA to isobutyraldehyde, typically using either NADH or NADPH as an electron donor. Example acylating aldehyde dehydrogenases are known by the EC numbers 1.2.1.10 and 1.2.1.57. Such enzymes are available from multiple sources, including, but not limited to, *Clostridium beijerinckii* (GenBank Nos: AAD31841 (SEQ ID NO: 64), AF157306 (SEQ ID NO: 65)), *Clostridium acetobutylicum* (GenBank Nos: NP_149325 (SEQ ID NO: 66), NC_001988 (SEQ ID NO: 67); NP_149199 (SEQ ID NO: 68), NC_001988 (SEQ ID NO: 69)), *P. putida* (GenBank Nos: AAA89106 (SEQ ID NO: 70), U13232 (SEQ ID NO: 71)), and *Thermus thermophilus* (GenBank Nos: YP_145486 (SEQ ID NO: 72), NC_006461 (SEQ ID NO: 73)).

The term "transaminase" refers to a polypeptide (or polypeptides) having an enzyme activity that catalyzes the conversion of α-ketoisovalerate to L-valine, using either alanine or glutamate as an amine donor. Example transaminases are known by the EC numbers 2.6.1.42 and 2.6.1.66. Such enzymes are available from a number of sources. Examples of sources for alanine-dependent enzymes include, but are not limited to, *E. coli* (GenBank Nos: YP_026231 (SEQ ID NO: 74), NC_000913 (SEQ ID NO: 75)) and *Bacillus licheniformis* (GenBank Nos: YP_093743 (SEQ ID NO: 76), NC_006322 (SEQ ID NO: 77)). Examples of sources for glutamate-dependent enzymes include, but are not limited to, *E. coli* (GenBank Nos: YP_026247 (SEQ ID NO: 78), NC_000913 (SEQ ID NO: 79)), *Saccharomyces cerevisiae* (GenBank Nos: NP_012682 (SEQ ID NO: 80), NC_001142 (SEQ ID NO: 81)) and *Methanobacterium thermoautotrophicum* (GenBank Nos: NP_276546 (SEQ ID NO: 82), NC_000916 (SEQ ID NO: 83)).

The term "valine dehydrogenase" refers to a polypeptide (or polypeptides) having an enzyme activity that catalyzes the conversion of α-ketoisovalerate to L-valine, typically using NAD(P)H as an electron donor and ammonia as an amine donor. Example valine dehydrogenases are known by the EC numbers 1.4.1.8 and 1.4.1.9 and such enzymes are available from a number of sources, including, but not limited to, *Streptomyces coelicolor* (GenBank Nos: NP_628270 (SEQ ID NO: 84), NC_003888 (SEQ ID NO: 85)) and *Bacillus subtilis* (GenBank Nos: CAB14339 (SEQ ID NO: 86), Z99116 (SEQ ID NO: 87)).

The term "valine decarboxylase" refers to a polypeptide (or polypeptides) having an enzyme activity that catalyzes the conversion of L-valine to isobutylamine and $CO_2$. Example valine decarboxylases are known by the EC number 4.1.1.14. Such enzymes are found in *Streptomyces*, such as for example, *Streptomyces viridifaciens* (GenBank Nos: AAN10242 (SEQ ID NO: 88), AY116644 (SEQ ID NO: 89)).

The term "omega transaminase" refers to a polypeptide (or polypeptides) having an enzyme activity that catalyzes the conversion of isobutylamine to isobutyraldehyde using a suitable amino acid as an amine donor. Example omega transaminases are known by the EC number 2.6.1.18 and are available from a number of sources, including, but not limited to, *Alcaligenes denitrificans* (AAP92672 (SEQ ID NO: 90), AY330220 (SEQ ID NO: 91)), *Ralstonia entropha* (GenBank Nos: YP_294474 (SEQ ID NO: 92), NC_007347 (SEQ ID NO: 93)), *Shewanella oneidensis* (GenBank Nos: NP_719046 (SEQ ID NO: 94), NC_004347 (SEQ ID NO: 95)), and *P. putida* (GenBank Nos: AAN66223 (SEQ ID NO: 96). AE016776 (SEQ ID NO: 97)).

The term "acetyl-CoA acetyltransferase" refers to a polypeptide (or polypeptides) having an enzyme activity that catalyzes the conversion of two molecules of acetyl-CoA to acetoacetyl-CoA and coenzyme A (CoA). Example acetyl-CoA acetyltransferases are acetyl-CoA acetyltransferases with substrate preferences (reaction in the forward direction) for a short chain acyl-CoA and acetyl-CoA and are classified as E.C. 2.3.1.9 [Enzyme Nomenclature 1992, Academic Press, San Diego]; although, enzymes with a broader substrate range (E.C. 2.3.1.16) will be functional as well. Acetyl-CoA acetyltransferases are available from a number of sources, for example, *E. coli* (GenBank Nos: NP_416728, NC_000913; NCBI amino acid sequence, NCBI nucleotide sequence), *Clostridium acetobutylicum* (GenBank Nos: NP_349476.1, NC_003030: NP_149242, NC_001988), *Bacillus subtilis* (GenBank Nos: NP_390297, NC_000964), and *Saccharomyces cerevisiae* (GenBank Nos: NP_015297, NC_001148).

The term "3-hydroxybutyryl-CoA dehydrogenase" refers to a polypeptide (or polypeptides) having an enzyme activity that catalyzes the conversion of acetoacetyl-CoA to 3-hydroxybutyryl-CoA. Example 3-hydroxybutyryl-CoA dehydrogenases may be NADH-dependent, with a substrate preference for (S)-3-hydroxybutyryl-CoA or (R)-3-hydroxybutyryl-CoA. Examples may be classified as E.C. 1.1.1.35 and E.C. 1.1.1.30, respectively. Additionally, 3-hydroxybutyryl-CoA dehydrogenases may be NADPH-dependent, with a substrate preference for (S)-3-hydroxybutyryl-CoA or (R)-3-hydroxybutyryl-CoA and are classified as E.C. 1.1.1.157 and E.C. 1.1.1.36, respectively. 3-Hydroxybutyryl-CoA dehydrogenases are available from a number of sources, for example, *Clostridium acetobutylicum* (GenBank Nos: NP_349314, NC_003030), *Bacillus subtilis* (GenBank Nos: AAB09614, U29084), *Ralstonia eutropha* (GenBank Nos: YP_294481, NC_007347), and *Alcaligenes eutrophus* (GenBank Nos: AAA21973, J04987).

The term "crotonase" refers to a polypeptide (or polypeptides) having an enzyme activity that catalyzes the conversion of 3-hydroxybutyryl-CoA to crotonyl-CoA and $H_2O$. Example crotonases may have a substrate preference for (S)-3-hydroxybutyryl-CoA or (R)-3-hydroxybutyryl-CoA and may be classified as E.C. 4.2.1.17 and E.C. 4.2.1.55, respectively. Crotonases are available from a number of sources, for example, *E. coli* (GenBank Nos: NP_415911, NC_000913), *Clostridium acetobutylicum* (GenBank Nos: NP_349318, NC_003030), *Bacillus subtilis* (GenBank Nos: CAB13705, Z99113), and *Aeromonas caviae* (GenBank Nos: BAA21816, D88825).

The term "butyryl-CoA dehydrogenase" refers to a polypeptide (or polypeptides) having an enzyme activity that catalyzes the conversion of crotonyl-CoA to butyryl-CoA. Example butyryl-CoA dehydrogenases may be NADH-dependent, NADPH-dependent, or flavin-dependent and may be classified as E.C. 1.3.1.44, E.C. 1.3.1.38, and E.C. 1.3.99.2, respectively. Butyryl-CoA dehydrogenases are available from a number of sources, for example, *Clostridium acetobutylicum* (GenBank Nos: NP_347102, NC_003030), *Euglena gracilis* (GenBank Nos: Q5EU90, AY741582), *Streptomyces collinus* (GenBank Nos: AAA92890, U37135), and *Streptomyces coelicolor* (GenBank Nos: CAA22721, AL939127).

The term "butyraldehyde dehydrogenase" refers to a polypeptide (or polypeptides) having an enzyme activity that catalyzes the conversion of butyryl-CoA to butyraldehyde, using NADH or NADPH as cofactor. Butyraldehyde dehydrogenases with a preference for NADH are known as E.C. 1.2.1.57 and are available from, for example, *Clostridium beijerinckii* (GenBank Nos: AAD31841, AF157306) and *Clostridium acetobutylicum* (GenBank Nos: NP.sub.-149325, NC.sub.-001988).

The term "isobutyryl-CoA mutase" refers to a polypeptide (or polypeptides) having an enzyme activity that catalyzes the conversion of butyryl-CoA to isobutyryl-CoA. This enzyme uses coenzyme B12 as cofactor. Example isobutyryl-CoA mutases are known by the EC number 5.4.99.13. These enzymes are found in a number of *Streptomyces*, including, but not limited to, *Streptomyces cinnamonensis* (GenBank Nos: AAC08713 (SEQ ID NO: 98), U67612 (SEQ ID NO: 99): CAB59633 (SEQ ID NO: 100), AJ246005 (SEQ ID NO: 101)), *Streptomyces coelicolor* (GenBank Nos: CAB70645 (SEQ ID NO: 102), AL939123 (SEQ ID NO: 103); CAB92663 (SEQ ID NO: 104), AL939121 (SEQ ID NO: 105)), and *Streptomyces avermitilis* (GenBank Nos: NP_824008 (SEQ ID NO: 106), NC_003155 (SEQ ID NO: 107); NP_824637 (SEQ ID NO: 108), NC_003155 (SEQ ID NO: 109)).

The term "acetolactate decarboxylase" refers to a polypeptide (or polypeptides) having an enzyme activity that catalyzes the conversion of alpha-acetolactate to acetoin. Example acetolactate decarboxylases are known as EC 4.1.1.5 and are available, for example, from *Bacillus subtilis* (GenBank Nos: AAA22223, L04470), *Klebsiella terrigena* (GenBank Nos: AAA25054, L04507) and *Klebsiella pneumoniae* (GenBank Nos: AAU43774, AY722056).

The term "acetoin aminase" or "acetoin transaminase" refers to a polypeptide (or polypeptides) having an enzyme activity that catalyzes the conversion of acetoin to 3-amino-2-butanol. Acetoin aminase may utilize the cofactor pyridoxal 5'-phosphate or NADH or NADPH. The resulting product may have (R) or (S) stereochemistry at the 3-position. The pyridoxal phosphate-dependent enzyme may use an amino acid such as alanine or glutamate as the amino donor. The NADH- and NADPH-dependent enzymes may use ammonia as a second substrate. A suitable example of an NADH-dependent acetoin aminase, also known as amino alcohol dehydrogenase, is described by Ito, et al., (U.S. Pat. No. 6,432,688). An example of a pyridoxal-dependent acetoin aminase is the amine:pyruvate aminotransferase (also called amine:pyruvate transaminase) described by Shin and Kim (J. Org. Chem. 67:2848-2853, 2002).

The term "acetoin kinase" refers to a polypeptide (or polypeptides) having an enzyme activity that catalyzes the conversion of acetoin to phosphoacetoin. Acetoin kinase may utilize ATP (adenosine triphosphate) or phosphoenolpyruvate as the phosphate donor in the reaction. Enzymes that catalyze the analogous reaction on the similar substrate dihydroxyacetone, for example, include enzymes known as EC 2.7.1.29 (Garcia-Alles, et al., Biochemistry 43:13037-13046, 2004).

The term "acetoin phosphate aminase" refers to a polypeptide (or polypeptides) having an enzyme activity that catalyzes the conversion of phosphoacetoin to 3-amino-2-butanol O-phosphate. Acetoin phosphate aminase may use the cofactor pyridoxal 5'-phosphate, NADH, or NADPH. The resulting product may have (R) or (S) stereochemistry at the 3-position. The pyridoxal phosphate-dependent enzyme may use an amino acid such as alanine or glutamate. The NADH- and NADPH-dependent enzymes may use ammonia as a second substrate. Although there are no reports of enzymes catalyzing this reaction on phosphoacetoin, there is a pyridoxal phosphate-dependent enzyme that is proposed to carry out the analogous reaction on the similar substrate serinol phosphate (Yasuta, et al., Appl. Environ. Microbial. 67:4999-5009, 2001).

The term "aminobutanol phosphate phospholyase," also called "amino alcohol O-phosphate lyase," refers to a polypeptide (or polypeptides) having an enzyme activity that catalyzes the conversion of 3-amino-2-butanol O-phosphate to 2-butanone. Amino butanol phosphate phospho-lyase may utilize the cofactor pyridoxal 5'-phosphate. There are reports of enzymes that catalyze the analogous reaction on the similar substrate 1-amino-2-propanol phosphate (Jones, et al., Biochem J. 134:167-182, 1973). U.S. Patent Application Publication No. 2007/0259410 describes an aminobutanol phosphate phospho-lyase from the organism *Erwinia carotovora*.

The term "aminobutanol kinase" refers to a polypeptide (or polypeptides) having an enzyme activity that catalyzes the conversion of 3-amino-2-butanol to 3-amino-2-butanol O-phosphate. Amino butanol kinase may utilize ATP as the phosphate donor. Although there are no reports of enzymes catalyzing this reaction on 3-amino-2-butanol, there are reports of enzymes that catalyze the analogous reaction on the similar substrates ethanolamine and 1-amino-2-propanol (Jones, et al., supra). U.S. Patent Application Publication No. 2009/0155870 describes, in Example 14, an amino alcohol kinase of *Erwinia carotovora* subsp. *Atroseptica*.

The term "butanediol dehydrogenase" also known as "acetoin reductase" refers to a polypeptide (or polypeptides) having an enzyme activity that catalyzes the conversion of acetoin to 2,3-butanediol. Butanedial dehydrogenases are a subset of the broad family of alcohol dehydrogenases. Butanediol dehydrogenase enzymes may have specificity for production of (R)- or (S)-stereochemistry in the alcohol product. (S)-specific butanediol dehydrogenases are known as EC 1.1.1.76 and are available, for example, from *Klebsiella pneumoniae* (GenBank Nos: BBA13085, D86412). (R)-specific butanediol dehydrogenases are known as EC 1.1.1.4 and are available, for example, from *Bacillus cereus* (GenBank Nos. NP 830481, NC_004722; AAP07682, AE017000), and *Lactococcus lactis* (GenBank Nos. AAK04995, AE006323).

The term "butanediol dehydratase," also known as "dial dehydratase" or "propanediol dehydratase" refers to a polypeptide (or polypeptides) having an enzyme activity that catalyzes the conversion of 2,3-butanediol to 2-butanone. Butanediol dehydratase may utilize the cofactor adenosyl cobalamin (also known as coenzyme Bw or vitamin B12; although vitamin B12 may refer also to other forms of cobalamin that are not coenzyme B12). Adenosyl cobalamin-dependent enzymes are known as EC 4.2.1.28 and are available, for example, from *Klebsiella oxytoca* [(GenBank Nos: AA08099 (alpha subunit), D45071; BAA08100 (beta subunit), D45071; and BBA08101 (gamma subunit), D45071 (Note all three subunits are required for activity)], and *Klebsiella pneumonia* (GenBank Nos: AAC98384 (alpha subunit), AF102064; AAC98385 (beta subunit), AF102064; AAC98386 (gamma subunit), AF102064). Other suitable dial dehydratases include, but are not limited to, B12-dependent dial dehydratases available from *Salmonella typhimurium* (GenBank Nos: AAB84102 (large subunit), AF026270; AAB84103 (medium subunit), AF026270; AAB84104 (small subunit), AF026270); and *Lactobacillus collinoides* (GenBank Nos: CAC82541 (large subunit), AJ297723; CAC82542 (medium subunit); AJ297723; CAD01091 (small subunit), AJ297723); and enzymes from *Lactobacillus brevis* (particularly strains CNRZ 734 and CNRZ 735, Speranza, et al., J. Agric. Food Chem. 45:3476-3480, 1997), and nucleotide sequences that encode the corresponding enzymes. Methods of dial dehydratase gene isolation are well known in the art (e.g., U.S. Pat. No. 5,686,276).

The term "pyruvate decarboxylase" (PDC) refers to a polypeptide (or polypeptides) having an enzyme activity that catalyzes the decarboxylation of pyruvic acid to acetaldehyde and carbon dioxide. Pyruvate dehydrogenases are known by the EC number 4.1.1.1. These enzymes are found in a number of yeast, including *Saccharomyces cerevisiae* (GenBank Nos: CAA97575 (SEQ ID NO: 110), CAA97705 (SEQ ID NO: 112), CAA97091 (SEQ ID NO: 114)).

It will be appreciated that microorganisms comprising an isobutanol biosynthetic pathway as provided herein may further comprise one or more additional modifications. U.S. Patent Application Publication No. 2009/0305363 (incorporated by reference) discloses increased conversion of pyruvate to acetolactate by engineering yeast for expression of a cytosol-localized acetolactate synthase and substantial elimination of pyruvate decarboxylase activity. In some embodiments, the microorganisms may comprise modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Application Publication No. 2009/0305363 (incorporated herein by reference), modifications to a microorganism that provide for increased carbon flux through an Entner-Doudoroff Pathway or reducing equivalents balance as described in U.S. Patent Application Publication No. 2010/0120105 (incorporated herein by reference). Other modifications include integration of at least one polynucleotide encoding a polypeptide that catalyzes a step in a pyruvate-utilizing biosynthetic pathway. Other modifications include at least one deletion, mutation, and/or substitution in an endogenous polynucleotide encoding a polypeptide having acetolactate reductase activity. In some embodiments, the polypeptide having acetolactate reductase activity is YMR226c (SEQ ID NOs: 130, 131) of *Saccharomyces cerevisiae* or a homolog thereof. Additional modifications include an insertion, deletion, mutation, and/or substitution in an endogenous polynucleotide encoding a polypeptide having aldehyde dehydrogenase and/or aldehyde oxidase activity. In some embodiments, the polypeptide having aldehyde dehydrogenase activity is ALD6 from *Saccharomyces cerevisiae* or a homolog thereof. A genetic modification which has the effect of reducing glucose repression wherein the yeast production host cell is pdc– is described in U.S. Patent Application Publication No. 2011/0124060, incorporated herein by reference. In some embodiments, the pyruvate decarboxylase that is deleted or down-regulated is selected from the group consisting of: PDC1, PDC5, PDC6, and combinations thereof. In some embodiments, the pyruvate decarboxylase is selected from those enzymes in Table 3 (SEQ ID Numbers of PDC Target Gene coding regions and Proteins). In some embodiments, microorganisms may contain a deletion or down-regulation of a polynucleotide encoding a polypeptide that catalyzes the conversion of glyceraldehyde-3-phosphate to glycerate 1,3, bisphosphate. In some embodiments, the enzyme that catalyzes this reaction is glyceraldehyde-3-phosphate dehydrogenase.

TABLE 3

| Description | SEQ ID NO: Amino Acid | SEQ ID NO: Nucleic Acid |
|---|---|---|
| PDC1 pyruvate decarboxylase from *Saccharomyces cerevisiae* | 110 | 111 |
| PDC5 pyruvate decarboxylase from *Saccharomyces cerevisiae* | 112 | 113 |
| PDC6 pyruvate decarboxylase *Saccharomvces cerevisiae* | 114 | 115 |
| pyruvate decarboxylase from *Candida glabrata* | 116 | 117 |
| PDC1 pyruvate decarboxylase from *Pichia stipitis* | 118 | 119 |

TABLE 3-continued

| Description | SEQ ID NO: Amino Acid | SEQ ID NO: Nucleic Acid |
|---|---|---|
| PDC2 pyruvate decarboxylase from *Pichia stipitis* | 120 | 121 |
| pyruvate decarboxylase from *Kluyveromyces lactis* | 122 | 123 |
| pyruvate decarboxylase from *Yarrowia lipolytica* | 124 | 125 |
| pyruvate decarboxylase from *Schizosaccharomyces pombe* | 126 | 127 |
| pyruvate decarboxylase from *Zygosaccharomyces rouxii* | 128 | 129 |

Yeasts may have one or more genes encoding pyruvate decarboxylase. For example, there is one gene encoding pyruvate decarboxylase in *Candida glabrata* and *Schizosaccharomyces pombe*, while there are three isozymes of pyruvate decarboxylase encoded by the PDC1, PCD5, and PDC6 genes in *Saccharomyces cerevisiae*. In some embodiments, yeast cells may have at least one PDC gene is inactivated. If the yeast cell has more than one expressed (active) PDC gene, then each of the active PDC genes may be modified or inactivated thereby producing a pdc– cell. For example, in *Saccharomyces cerevisiae*, the PDC1, PDC5, and PDC6 genes may be modified or inactivated. If a PDC gene is not active under the fermentation conditions to be used, then such a gene would not need to be modified or inactivated.

Other target genes, such as those encoding pyruvate decarboxylase proteins having at least about 70-75%, at least about 75-85%, at least about 80-85%, at least about 85%-90%, at least about 90%-95%, or at least about 96%, at least about 97%, at least about 98%0, or at least about 99% sequence identity to the pyruvate decarboxylases of SEQ ID NOs: 110, 112, 114, 116, 118, 120, 122, 124, 126, or 128 may be identified in the literature and in bioinformatics databases well known to the skilled person.

Microorganisms may further comprise (a) at least one heterologous polynucleotide encoding a polypeptide having dihydroxy-acid dehydratase activity: and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In some embodiments, the polypeptide affecting Fe—S cluster biosynthesis is encoded by AFT1, AFT2, FRA2, GRX3, or CCC1. AFT1 and AFT2 are described in PCT Application Publication No. WO 2001/103300, which is incorporated herein by reference. In some embodiments, the polypeptide affecting Fe—S cluster biosynthesis is constitutive mutant AFT1 L99A, AFT1 L102A, AFT1 C291F, or AFT C293F.

Detection Methods

Disclosed herein are methods and processes suitable for production of butanol from a carbon substrate and employing a microorganism (e.g., recombinant host cell). The ability to utilize carbon substrates to produce isobutanol can be confirmed using methods known in the art, including, but not limited to those described in U.S. Pat. No. 7,851,188, which is incorporated herein by reference. For example, to confirm utilization of sucrose to produce isobutanol, the concentration of isobutanol in the culture media can be determined by a number of methods known in the art. For example, a specific high performance liquid chromatography (HPLC) method utilized a Shodex™ SH-1011 column with a Shodex™ SH-G guard column, (Waters Corporation, Milford, Mass.), with refractive index (RI) detection. Chromatographic separation was achieved using 0.01 M $H_2SO_4$ as the mobile phase with a flow rate of 0.5 mL/min and a column temperature of 50° C. Isobutanol had a retention time of 46.6 min under the conditions used. Alternatively, gas chromatography (GC) methods are available. For example, a specific GC method utilized an HP-INNOWax column (30 m×0.53 mm id, 1 μm film thickness, Agilent Technologies, Wilmington, Del.), with a flame ionization detector (FID). The carrier gas was helium at a flow rate of 4.5 mL/min, measured at 150° C. with constant head pressure; injector split was 1:25 at 200° C.; oven temperature was 45° C. for 1 min, 45 to 220° C. at 10° C./min, and 220° C. for 5 min; and FID detection was employed at 240° C. with 26 mL/min helium makeup gas. The retention time of isobutanol was 4.5 min.

Butanol Production

Disclosed herein are methods and processes suitable for production of butanol and employing a microorganism (e.g., recombinant host cell), and methods to improve cell viability and productivity.

The term "cell recycling" or "cell recycle" refers to the process whereby yeast or other microorganisms (e.g., recombinant host cells) are separated from fermentation broth, such as by centrifugation, and then re-circulating the yeast back to the fermentor.

In some embodiments, the cell recycling step is repeated at least about 2 times, at least about 3 times, at least about 4 times, at least about 5 times, at least about 10 times, at least about 20 times, at least about 30 times, at least about 40 times, at least about 50 times, at least about 75 times, at least about 100 times, at least about 125 times, at least about 150 times, at least about 175 times, at least about 200 times, at least about 250 times, at least about 300 times, at least about 400 times, at least about 500 times, or more.

The term "acid washing," "acid washed," or "acid wash" refers to any acid washing of cell suspensions. In some embodiments, the cell suspension may be suspensions of yeast or other microorganisms (e.g., recombinant host cells). Acid washing overcomes difficulties in the prior art in connection with the efficient conversion of carbon substrates to butanol or other fermentation products due to the presence of microbial contaminants. Acid washing is described in U.S. Application Publication No. 2011/0207192, which is incorporated herein by reference.

During the acid washing step, the microbial contaminants are exposed at a pH that is less than about 2.0 by the addition of acid. The pH may be greater than about 1, but less than 3.0. This includes all subvalues there between, for example a pH of at least about 1.0, 1.1, 1.2, 1.3, 1.4, 1.5, 1.6, 1.7, 1.8, 1.9, 2.0, 2.1, 2.2, 2.3, 2.4, 2.5, 2.6, 2.7, 2.8 or 2.9, or any pH there between, is included within the scope of the invention. Examples of pH ranges that may be employed include at least about 1.0 to at least about 3.0, at least about 1.0 to at least about 2.9, at least about 1.0 to at least about 2.8, at least about 1.0 to at least about 2.75, at least about 1.0 to at least about 2.5, at least about 1.0 to at least about 2.4, at least about 1.0 to at least about 2.3, at least about 1.0 to at least about 2.2, at least about 1.0 to at least about 2.1, or at least about 1.0 to at least about 2.0.

In one embodiment of the invention, the acid is a mineral acid selected from the group consisting of: sulfuric acid, hydrochloric acid, sulfurous acid, phosphoric acid and nitric acid.

In some embodiments, the acid washing step is repeated at least about 2 times, at least about 3 times, at least about 4 times, at least about 5 times, at least about 10 times, at least about 20 times, at least about 30 times, at least about 40 times, at least about 50 times, at least about 75 times, at least about 100 times, at least about 125 times, at least about 150 times, at least about 175 times, at least about 200 times, at least about 250 times, at least about 300 times, at least about 400 times, at least about 500 times, or more.

In some embodiments, the recombinant host cell undergoes an acid washing step during cell recycling. In some embodiments, the recombinant host cell undergoes an acid washing step after cell recycling. In some embodiments, the recombinant host cell undergoes an acid washing step with each cell recycling step. In some embodiments, the recombinant host cell undergoes an acid washing step with at least about every other cell recycling step, at least about every third cell recycling step, at least about every fourth cell recycling step, at least about every fifth cell recycling step, at least about every sixth cell recycling step, at least about every seventh cell recycling step, at least about every eighth cell recycling step, at least about every ninth cell recycling step, at least about every tenth cell recycling step, at least about every fifteenth cell recycling step, at least about every twentieth cell recycling step, or more.

The term "rejuvenation" refers to a process whereby yeast or other microorganisms (e.g., recombinant host cells) are separated from the fermentation broth, such as by centrifugation, and exposed to a nutrient rich medium for a period of time.

The term "nutrient rich medium" refers to medium, formulations, or compositions which may contain any of the following: carbon substrate, nitrogen, minerals, trace elements, and vitamins. For example, the nutrient rich medium may contain any of the following: biotin, pantothenate, folic acid, niacin, aminobenzoic acid, pyridoxine, riboflavin, thiamine, inositol, potassium (e.g., potassium phosphate), boric acid, calcium, chromium, copper (e.g., copper sulfate), iodide (e.g., potassium iodide), iron (e.g., ferric chloride), lithium, magnesium (e.g., magnesium sulfate), manganese (e.g., manganese sulfate), molybdenum, calcium chloride, sodium chloride, vanadium, zinc (e.g., zinc sulfate), yeast extract, soy peptone, and the like.

In some embodiments, the rejuvenation process may repeated at least about 2 times, at least about 3 times, at least about 4 times, at least about 5 times, at least about 10 times, at least about 20 times, or more.

In some embodiments, the recombinant host cell undergoes a rejuvenation process after an acid washing step. In some embodiments, the recombinant host cell undergoes the rejuvenation process after each acid washing. In some embodiments, the recombinant host cell undergoes the rejuvenation process at least about every other acid washing step, at least about every third acid washing step, at least about every fourth acid washing step, at least about every fifth acid washing step, at least about every sixth acid washing step, at least about every seventh acid washing step, at least about every acid washing step, at least about every ninth acid washing step, at least about every tenth acid washing step, or more.

One embodiment of the invention is directed to a process for producing an alcohol comprising:
  (a) providing a microorganism, wherein the microorganism produces an alcohol;
  (b) contacting the microorganism with one or more carbon sources under conditions wherein the alcohol is produced;
  (c) collecting the microorganism;
  (d) recovering the alcohol;
  (e) contacting the microorganism of step (c) with one or more carbon sources under conditions wherein the alcohol is produced;
  (f) repeating steps (c)-(e); and
    optionally, exposing the collected microorganism of step (c) to low pH conditions.

One embodiment of the invention is directed to a process for producing butanol comprising:
  (a) providing a microorganism, wherein the microorganism produces butanol;
  (b) contacting the microorganism with one or more carbon substrates under conditions wherein butanol is produced at an effective yield;
  (c) collecting the microorganism;
  (d) recovering butanol;
  (e) contacting the microorganism of step (c) with one or more carbon substrates under conditions wherein butanol is produced at an effective yield;
  (f) repeating steps (c)-(e); and, optionally
    exposing the microorganism of step (c) to low pH conditions.

One embodiment of the invention is directed to a process for producing an alcohol comprising:
  (a) providing a microorganism, wherein the microorganism produces an alcohol;
  (b) contacting the microorganism with one or more carbon substrates under conditions wherein the alcohol is produced;
  (c) collecting the microorganism;
  (d) recovering the alcohol;
  (e) contacting the microorganism of step (c) with a nutrient rich medium;
  (f) collecting the microorganism of step (e);
  (g) contacting the microorganism of step (f) with one or more carbon substrates under conditions wherein the alcohol is produced at an effective yield;
  (h) repeating steps (c)-(g).

One embodiment of the invention is directed to a process for producing butanol comprising:
  (a) providing a microorganism, wherein the microorganism produces butanol;
  (b) contacting the microorganism with one or more carbon substrates under conditions wherein butanol is produced at an effective yield;
  (c) collecting the microorganism;
  (d) recovering butanol;
  (e) contacting the microorganism of step (c) with a nutrient rich medium;
  (f) collecting the microorganism of step (e);
  (g) contacting the microorganism of step (f) with one or more carbon substrates under conditions wherein butanol is produced at an effective yield;
  (h) repeating steps (c)-(g).

One embodiment of the invention is directed to a process for producing an alcohol comprising:
  (a) providing a microorganism, wherein the microorganism produces an alcohol;
  (b) contacting the microorganism with one or more carbon substrates under conditions wherein the alcohol is produced;
  (c) collecting the microorganism;
  (d) recovering the alcohol;
  (e) exposing the microorganism of step (c) to low pH conditions;
  (f) collecting the microorganism from step (e);
  (g) contacting the microorganism of step (f) with a nutrient rich medium;

(h) collecting the microorganism of step (g);
(i) contacting the microorganism of step (h) with one or more carbon substrates under conditions wherein the alcohol is produced; and
(j) optionally repeating steps (c)-(i).

One embodiment of the invention is directed to a process for producing butanol comprising:
(a) providing a microorganism, wherein the microorganism produces butanol;
(b) contacting the microorganism with one or more carbon substrates under conditions wherein butanol is produced at an effective yield;
(c) collecting the microorganism;
(d) recovering butanol;
(e) exposing the microorganism of step (c) to low pH conditions;
(f) collecting the microorganism from step (e);
(g) contacting the microorganism of step (f) with a nutrient rich medium;
(h) collecting the microorganism of step (g);
(i) contacting the microorganism of step (h) with one or more carbon substrates under conditions wherein butanol is produced at an effective yield; and
(j) optionally repeating steps (c)-(i).

In some embodiments, the pH is less than or equal to about 2.0. In some embodiments, the pH conditions may be about 2 to about 4. In some embodiments, the collected microorganism may be exposed to conditions of pH less than or equal to about 2.0 for at least one hour. In some embodiments, the alcohol produced is methanol, ethanol, propanol, butanol, pentanol, or hexanol. In some embodiments, the butanol is isobutanol, 1-butanol, 2-butanol, or 2-butanone.

In some embodiments where butanol is produced, butanol is recovered at a concentration of at least about 6 g/L. In some embodiments, the effective yield of the second contacting step (e.g., steps (e), (g), (i)) is at least about 90% of the effective yield of the first contacting step (e.g., step (b)). In some embodiments, the effective yield of the second contacting step (e.g., steps (e), (g), (i)) is at least about 99% of the effective yield of the first contacting step (e.g., step (b)). In some embodiments, the microorganism is exposed for at least about one hour and/or in the presence of at least about 0.3% butanol.

In some embodiments, the microorganism is recycled at least 5 times. In some embodiments, the microorganism is recycled at least 10 times. In some embodiments, the microorganism is acid washed during the recycling step. In some embodiments, the microorganism is acid washed after the recycling step.

In some embodiments, after the desired isobutanol production, the microorganism may be collected. The collection may be carried out by any method known in the art, including, for example, centrifugation. In some embodiments, the collected microorganism may be subjected to acidic conditions and then re-contacted with the carbon substrate in an acid washing step. In some embodiments of the invention employing cell recycle, the acid may be added to the cell suspension that is separated from the fermentation broth before re-contacting the acid-treated cells with the carbon substrate. In some embodiments, the collected microorganism may be subjected to a nutrient rich medium for a period of time, collected and re-contacted with the carbon substrate. In some embodiments, the microorganism may be subjected to acid washing prior to exposure to the nutrient rich medium.

In some embodiments, the first contacting with the carbon substrate may occur in anaerobic conditions. In some embodiments, the first contacting with the carbon substrate may occur in microaerobic conditions. In some embodiments, recycling may occur in anaerobic conditions. In some embodiments, recycling may occur in microaerobic conditions.

In some embodiments, the carbon substrate is selected from the group consisting of: oligosaccharides, polysaccharides, monosaccharides, and mixtures thereof. In some embodiments, the carbon substrate is selected from the group consisting of: fructose, glucose, lactose, maltose, galactose, sucrose, starch, cellulose, feedstocks, ethanol, lactate, succinate, glycerol, corn mash, sugar cane, biomass, a C5 sugar such as xylose and arabinose, and mixtures thereof.

In some embodiments, the microorganism is contacted with carbon substrates under conditions whereby isobutanol is produced. In some embodiments, the microorganism at a given cell density may be added to a fermentation vessel along with suitable media. In some embodiments, the media may contain the carbon substrate, or the carbon substrate may be added separately. In some embodiments, the carbon substrate may be present at any concentration at the start of and/or during production of isobutanol. In some embodiments, the initial concentration of carbon substrate is in the range of about 60 to 80 g/L. Suitable temperatures for fermentation are known to those of skill in the art and will depend on the genus and/or species of the microorganism employed. In some embodiments, suitable temperatures are in the range of 25° C. to 43° C.

In some embodiments, the contact occurs until at least about 90% of the sucrose is utilized or until a desired effective titer of isobutanol is reached. In some embodiments, the effective titer of isobutanol is at least about 40 g/L, at least about 50 g/L, at least about 60 g/L, at least about 70 g/L, at least about 80 g/L, at least about 90 g/L, at least about 100 g/L, or at least about 110 g/L.

In some embodiments, the microorganism may be incubated at a temperature range of 30° C. to 37° C. In some embodiments, the microorganism may be incubated at for a time period of one to five hours. In some embodiments, the microorganism may be incubated with agitation (e.g., 100 to 400 rpm) in shakers (Innova 44R, New Brunswick Scientific, CT, USA).

The contact between the microorganism and the carbon substrate may be any length of time whereby isobutanol is produced. In some embodiments, the contacting of the microorganism with one or more carbon substrates is at least about 8 hours, at least about 12 hours, at least about 24 hours, at least about 36 hours, at least about 48 hours, at least about 72 hours, at least about 96 hours, at least about 120 hours, at least about 144 hours, at least about 168 hours, at least about 192 hours, at least about 216 hours, or more. In some embodiments, the microorganism is acid washed after the contacting step. In some embodiments, the contact occurs for less than 8 hours.

In some embodiments, the microorganism is present at a cell density of at least about 0.5 gdcw/L at the first contacting with the carbon substrate. In some embodiments, the microorganism may be grown to a cell density of at least about 6 gdcw/L prior to contacting with carbon substrate for the production of isobutanol. In some embodiments, the cell density may be at least about 20 gdcw/L, at least about 25 gdcw/L, or at least about 35 gdcw/L, prior to contact with carbon substrate.

In some embodiments, the microorganism has a specific productivity of at least about 0.1 g/gdcw/h. In some embodiments, butanol is produced at an effective rate of at least about 0.1 g/gdcw/h during the first contacting with the carbon substrate. In some embodiments, the first contacting with the carbon substrate occurs in the presence of an extractant. In some embodiments, the microorganism maintains a sugar uptake rate of at least about 1.0 g/gdcw/h. In some embodiments, the microorganism maintains a sugar uptake rate of at least about 0.5 g/g/hr. In some embodiments, the glucose utilization rate is at least about 2.5 g/gdcw/h. In some embodiments, the sucrose uptake rate is at least about 2.5 g/gdcw/h. In some embodiments, the combined glucose and fructose uptake rate is at least about 2.5 g/gdcw/h.

In some embodiments, the first contacting with the carbon substrate may occur in the presence of an extractant. In some embodiments, the first contacting with the carbon substrate in the presence of an extractant occurs in anaerobic conditions. In some embodiments, the first contacting with the carbon substrate in the presence of an extractant occurs in microaerobic conditions.

In some embodiments, the microorganism produces butanol at least about 90% of effective yield, at least about 91% of effective yield, at least about 92% of effective yield, at least about 93% of effective yield, at least about 94% of effective yield, at least about 95% of effective yield, at least about 96% of effective yield, at least about 97% of effective yield, at least about 98% of effective yield, or at least about 99% of effective yield. In some embodiments, the microorganism produces butanol at least about 55% to at least about 75% of effective yield, at least about 50% to at least about 80% of effective yield, at least about 45% to at least about 85% of effective yield, at least about 40% to at least about 90% of effective yield, at least about 35% to at least about 95% of effective yield, at least about 30% to at least about 99% of effective yield, at least about 25% to at least about 99% of effective yield, at least about 10% to at least about 99% of effective yield or at least about 10% to at least about 100% of effective yield.

In some embodiments, the microorganism may be a recombinant host cell. In some embodiments, the recombinant host cell may comprise a butanol biosynthetic pathway. In some embodiments, the butanol biosynthetic pathway is an isobutanol biosynthetic pathway. In some embodiments, the isobutanol biosynthetic pathway comprises a polynucleotide encoding a polypeptide that catalyzes a substrate to product conversion selected from the group consisting of: (a) pyruvate to acetolactate; (b) acetolactate to 2,3-dihydroxyisovalerate; (c) 2,3-dihydroxyisovalerate to 2-ketoisovalerate; (d) 2-ketoisovalerate to isobutyraldehyde: and (e) isobutyraldehyde to isobutanol. In some embodiments, the isobutanol biosynthetic pathway comprises polynucleotides encoding polypeptides having acetolactate synthase activity, keto acid reductoisomerase activity, dihydroxy acid dehydratase activity, ketoisovalerate decarboxylase activity, and alcohol dehydrogenase activity.

In some embodiments, the isobutanol biosynthetic pathway may comprise a polynucleotide encoding a polypeptide that catalyzes a substrate to product conversion selected from the group consisting of: (a) pyruvate to acetolactate; (b) acetolactate to 2,3-dihydroxyisovalerate; (c) 2,3-dihydroxyisovalerate to α-ketoisovalerate; (d) α-ketoisovalerate to isobutyryl-CoA; (e) isobutyryl-CoA to isobutyraldehyde; and (f) isobutyraldehyde to isobutanol. In some embodiments, the isobutanol biosynthetic pathway comprises polynucleotides encoding polypeptides having acetolactate synthase activity; acetohydroxy acid reductoisomerase activity; acetohydroxy acid dehydratase activity; branched-chain keto acid dehydrogenase activity; aldehyde dehydrogenase activity; and branched-chain alcohol dehydrogenase activity.

In some embodiments, the recombinant host cell may comprise a 1-butanol biosynthetic pathway. In some embodiments, the 1-butanol biosynthetic pathway may comprise a polynucleotide encoding a polypeptide that catalyzes a substrate to product conversion selected from the group consisting of: (a) acetyl-CoA to acetoacetyl-CoA; (b) acetoacetyl-CoA to 3-hydroxybutyryl-CoA; (c) 3-hydroxybutyryl-CoA to crotonyl-CoA; (d) crotonyl-CoA to butyryl-CoA; (e) butyryl-CoA to butyraldehyde; and (f) butyraldehyde to 1-butanol. In some embodiments, the 1-butanol biosynthetic pathway may comprise polynucleotides encoding polypeptides having acetyl-CoA acetyltransferase activity; 3-hydroxybutyryl-CoA dehydrogenase activity; crotonase activity; butyryl-CoA dehydrogenase activity; butyraldehyde dehydrogenase activity, and butanol dehydrogenase activity.

In some embodiments, the recombinant host cell may comprise a 2-butanol biosynthetic pathway. In some embodiments, the 2-butanol biosynthetic pathway comprises a polynucleotide encoding a polypeptide that catalyzes a substrate to product conversion selected from the group consisting of: (a) pyruvate to alpha-acetolactate; (b) alpha-acetolactate to acetoin; (c) acetoin to 3-amino-2-butanol; (d) 3-amino-2-butanol to 3-amino-2-butanol phosphate; (e) 3-amino-2-butanol phosphate to 2-butanone; and (f)-butanone to 2-butanol. In some embodiments, the 2-butanol biosynthetic pathway comprises polynucleotides encoding polypeptides having acetolactate synthase activity; acetolactate decarboxylase activity; acetonin aminase activity; aminobutanol kinase activity; aminobutanol phosphate phosphorylase activity; and butanol dehydrogenase activity.

In some embodiments, the 2-butanol biosynthetic pathway may comprise a polynucleotide encoding a polypeptide that catalyzes a substrate to product conversion selected from the group consisting of: (a) pyruvate to alpha-acetolactate; (b) alpha-acetolactate to acetoin; (c) acetoin to 2,3-butanediol; (d) 2,3-butanediol to 2-butanone; and (e) 2-butanone to 2-butanol. In some embodiments, the 2-butanol biosynthetic pathway comprises polynucleotides encoding polypeptides having acetolactate synthase activity; acetolactate decarboxylase activity; butanediol dehydrogenase activity; dial dehydratase activity; and butanol dehydrogenase activity.

In some embodiments, one or more of the substrate to product conversions utilizes NADH or NADPH as a cofactor. In some embodiments, NADH is the preferred cofactor.

In some embodiments, the butanol pathway of the recombinant host cell comprises at least one polypeptide selected from the group of enzymes having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66. EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.1.36, EC 4.2.1.17, EC 4.2.1.55, EC 1.3.1.44, EC 1.3.1.38, EC 5.4.99.13, EC 4.1.1.5, EC 2.7.1.29, EC 1.1.1.76, EC 1.2.1.57, and EC 4.2.1.28.

In some embodiments, the butanol pathway of the recombinant host cell comprises at least one polypeptide selected from the following group of enzymes: acetolactate synthase, acetohydroxy acid isomeroreductase, acetohydroxy acid dehydratase, branched-chain alpha-keto acid decarboxylase, branched-chain alcohol dehydrogenase, acylating aldehyde dehydrogenase, branched-chain keto acid dehydrogenase, butyryl-CoA dehydrogenase, butyraldehyde dehydrogenase, transaminase, valine dehydrogenase, valine decarboxylase, omega transaminase, acetyl-CoA acetyltransferase, 3-hydroxybutyryl-CoA dehydrogenase, crotonase, butyryl-CoA dehydrogenase, isobutyryl-CoA mutase, acetolactate decarboxylase, acetonin aminase, butanol dehydrogenase, butyraldehyde dehydrogenase, acetoin kinase, acetoin phosphate aminase, aminobutanol phosphate phospholyase, aminobutanol kinase, butanediol dehydrogenase, and butanediol dehydratase.

In some embodiments, enzymes from the biosynthetic pathways are localized to the cytosol. In some embodiments, enzymes from the biosynthetic pathways that are usually localized to the mitochondria are localized to the cytosol. In some embodiments, an enzyme from the biosynthetic pathways is localized to the cytosol by removing the mitochondrial targeting sequence. In some embodiments, mitochondrial targeting is eliminated by generating new start codons as described in, for example, U.S. Pat. No. 7,851,188, which is incorporated herein by reference in its entirety. In some embodiments, the enzyme from the biosynthetic pathway that is localized to the cytosol is DHAD. cIn some embodiments, the enzyme from the biosynthetic pathway that is localized to the cytosol is KARI.

In some embodiments, the recombinant host cell may comprise one or more modifications that alter expression and/or activity of one or more components of the cAMP signal transduction pathway. In some embodiments, the recombinant host cell may comprise one or more modifications that alter expression and/or activity of one or more phosphodiesterases. In some embodiments, the recombinant host cell may comprise reduced or eliminated phosphodiesterase and/or phosphodiesterase activity. In some embodiments, the recombinant host cell may comprise a modification in a polynucleotide encoding a polypeptide having phosphodiesterase activity. In some embodiments, the recombinant host cell may comprise an insertion, deletion, mutation, and/or substitution in an endogenous polynucleotide encoding a polypeptide having phosphodiesterase activity. In some embodiments, the polypeptide having phosphodiesterase activity corresponds to Enzyme Commission Number EC 3.1.4.17. In some embodiments, the polypeptide having phosphodiesterase activity is PDE1.

In some embodiments, the recombinant host cell does not express or has reduced expression of pyruvate decarboxylase. In some embodiments, the reduction in expression is the result of an insertion, deletion, mutation, and/or substitution in a gene encoding pyruvate decarboxylase. In some embodiments, the recombinant host cell may comprise a modification in a polynucleotide encoding a polypeptide having pyruvate decarboxylase activity. In some embodiments, the recombinant host cell may comprise an insertion, deletion, mutation, and/or substitution in an endogenous polynucleotide encoding a polypeptide having pyruvate decarboxylase activity. In some embodiments, the polypeptide having pyruvate decarboxylase activity is selected from the group consisting of: PDC1, PDC5, PDC6, and combinations thereof. In some embodiments, the endogenous polynucleotide encoding a polypeptide having pyruvate decarboxylase activity is selected from the group consisting of: PDC1, PDC5, PDC6, and combinations thereof.

In some embodiments, the recombinant host cell does not express or has reduced expression of glyceraldehyde-3-phosphate dehydrogenase. In some embodiments, the reduction in expression is the result of an insertion, deletion, mutation, and/or substitution in a gene encoding glyceraldehyde-3-phosphate dehydrogenase. In some embodiments, the recombinant host cell does not express or has reduced expression of BDH1. In some embodiments, the reduction in expression is the result of an insertion, deletion, mutation, and/or substitution in a gene encoding BDH1. In some embodiments, the recombinant host cell does not express or has reduced expression of a gene encoding acetolactate reductase. In some embodiments, the reduction in expression is the result of an insertion, deletion, mutation, and/or substitution in a gene encoding YMR226c.

The present invention is also directed to compositions comprising a recombinant host cell as described herein. In some embodiments, the composition also comprises a nutrient rich medium. In some embodiments, the composition may have a pH of at least about 2. In some embodiments, the composition may have a pH less than or equal to about 2. In some embodiments, the composition may have a pH of about 2 to about 4. In some embodiments, the recombinant host cell of the composition may be a member of the genus *Saccharomyces, Schizosaccharomyces, Hansenula, Candida, Kluhyveromyces, Yarrowia, Issatchenkia,* or *Pichia*. In some embodiments, the recombinant host cell of the composition is *Saccharomyces cerevisiae*. In some embodiments, the recombinant host cell may comprise an engineered enzyme which catalyzed the substrate to product conversion acetolactate to 2,3-dihydroxyisovalerate.

Butanologens

In some embodiments, the recombinant host cell may be a butanolgen. In some embodiments, the butanologen may be an isobutanologen. In some embodiments, suitable isobutanologens include any yeast host useful for genetic modification and recombinant gene expression. In some embodiments, the isobutanologen host cell may be a member of the genera *Schizosaccharomyces, Issatchenkia, Kluyveromyces, Yarrowia, Pichia, Candida, Hansenula,* or *Saccharomyces*. In some embodiments, the host cell may be *Saccharomyces cerevisiae, Schizosaccharomyces pombe, Kluyveromyces lactis, Kluvveromces hermotolerans, Kluvveromnyces marrianus, Candida glabrata, Candida albicans, Pichia stipitis, Yarrowia lipolytica, E. coli,* or *Lactobacillus plantarum*. In some embodiments, the host cell is a yeast host cell. In some embodiments, the host cell is a member of the genera *Saccharomyces*. In some embodiments, the host cell is *Kluyveromyces lactis, Candida glabrata,* or *Schizosaccharomyces pombe*. In some embodiments, the host cell is *Saccharomyces cerevisiae*. *Saccharomyces cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *Saccharomyces cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

"PNY860" refers to a strain derived from *Saccharomyces cerevisiae* which has been deposited at the ATCC under the Budapest Treaty on Jul. 21, 2011 at the American Type Culture Collection, Patent Depository 10801 University Boulevard, Manassas, Va. 20110-2209 and has the patent deposit designation PTA-12007.

In some embodiments, the isobutanologen is a derivative of PNY860. In some embodiments, the isobutanologen is a haploid derivative of strain PNY860. In some embodiments, the isobutanologen is a non-sporulating derivative of PNY860. In some embodiments, the isobutanologen is a non-mating derivative of PNY860.

Carbon Substrates

Suitable carbon substrates may include, but are not limited to, monosaccharides such as fructose or glucose; oligosaccharides such as lactose, maltose, galactose, or sucrose: polysaccharides such as starch or cellulose, or mixtures thereof and unpurified mixtures from renewable feedstocks such as cheese whey permeate, cornsteep liquor, sugar beet molasses, and barley malt. Other carbon substrates may include ethanol, lactate, succinate, or glycerol.

"Sugar" includes monosaccharides such as fructose or glucose; oligosaccharides such as lactose, maltose, galactose, or sucrose; polysaccharides such as starch or cellulose; C5 sugars such as xylose and arabinose; and mixtures thereof.

Additionally the carbon substrate may also be one-carbon substrates such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine, and a variety of amino acids for metabolic activity. For example, methylotrophic yeasts are known to utilize the carbon from methylamine to form trehalose or glycerol (Bellion, et al., *Microb. Growth C1 Compd.*, [Int. Symp.], 7th (1993), 415-32, Editor(s): Murrell, J. Collin: Kelly, Don P. Publisher: Intercept, Andover, UK). Similarly, various species of *Candida* will metabolize alanine or oleic acid (Sulter, et al., Arch. Microbiol. 153: 485-489, 1990). Hence, it is contemplated that the source of carbon utilized in the present invention may encompass a wide variety of carbon containing substrates and will only be limited by the choice of microorganism.

Although it is contemplated that all of the above mentioned carbon substrates and mixtures thereof are suitable in the present invention, in some embodiments, the carbon substrates are glucose, fructose, and sucrose, or mixtures of these with C5 sugars such as xylose and arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in U.S. Patent Application Publication No. 2007/0031918 A1, which is incorporated herein by reference. Biomass includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source: for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, leaves, wood chips, sawdust, animal manure, and mixtures thereof.

In some embodiments, the carbon substrate is glucose derived from corn. In some embodiments, the carbon substrate is glucose derived from wheat. In some embodiments, the carbon substrate is sucrose derived from sugar cane.

In addition to an appropriate carbon source, fermentation media may contain suitable minerals, salts, cofactors, buffers, and other components, known to those skilled in the art, suitable for the growth of the cultures and promotion of an enzymatic pathway described herein.

Fermentation Conditions

Typically cells are grown at a temperature in the range of about 20° C. to about 40° C. in an appropriate medium. Suitable growth media in the present invention include common commercially prepared media such as Sabouraud Dextrose (SD) broth, Yeast Medium (YM) broth, or broth that includes yeast nitrogen base, ammonium sulfate, and dextrose (as the carbon/energy source), or YPD Medium, a blend of peptone, yeast extract, and dextrose in optimal proportions for growing most *Saccharomyces cerevisiae* strains. Other defined or synthetic growth media may also be used, and the appropriate medium for growth of the particular microorganism will be known by one skilled in the art of microbiology or fermentation science. The use of agents known to modulate catabolite repression directly or indirectly, for example, cyclic adenosine 2':3'-monophosphate, may also be incorporated into the fermentation medium.

Suitable pH ranges for the fermentation are from about pH 5.0 to about pH 9.0. In one embodiment, about pH 6.0 to about pH 8.0 is used for the initial condition. Suitable pH ranges for the fermentation of yeast are typically from about pH 3.0 to about pH 9.0. In one embodiment, about pH 5.0 to about pH 8.0 is used for the initial condition. Suitable pH ranges for the fermentation of other microorganisms are from about pH 3.0 to about pH 7.5. In one embodiment, about pH 4.5 to about pH 6.5 is used for the initial condition.

Fermentations may be performed under aerobic or anaerobic conditions. In one embodiment, anaerobic or microaerobic conditions may be used for fermentations.

Industrial Batch and Continuous Fermentations

Isobutanol, or other fermentation products, may be produced using a batch method of fermentation. A classical batch fermentation is a closed system where the composition of the medium is set at the beginning of the fermentation and not subject to artificial alterations during the fermentation. A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Appl. Biochem. Biotechnol. 36:227, 1992.

Isobutanol, or other fermentation products, may also be produced using continuous fermentation methods. Continuous fermentation is an open system where a defined fermentation medium is added continuously to a fermentation vessel (e.g., bioreactor) and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other fermentation products, may be practiced using batch, fed-batch, or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol or other fermentative alcohols may be isolated from the fermentation medium using methods known in the art for ABE fermentations (see, e.g. Durre, Appl. Microbiol. Biotechnol. 49:639-648, 1998; Groot, et al., Process. Biochem. 27:61-75, 1992; and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, pervaporation, or combinations thereof.

Because isobutanol forms a low boiling point, azeotropic mixture with water, distillation may be used to separate the mixture up to its azeotropic composition. Distillation may be used in combination with another separation method to obtain separation around the azeotrope. Methods that may be used in combination with distillation to isolate and purify isobutanol include, but are not limited to, decantation, liquid-liquid extraction, adsorption, and membrane-based techniques. Additionally, isobutanol may be isolated using azeotropic distillation using an entrainer (see, e.g. Doherty and Malone, *Conceptual Design of Distillation Systems*, McGraw Hill, N.Y., 2001).

The isobutanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the distillation column as reflux. The isobutanol-rich decanted organic phase may be further purified by distillation, for example, in a second distillation column.

The isobutanol may be also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the isobutanol from the solvent.

Distillation in combination with adsorption may also be used to isolate isobutanol from the fermentation medium. In this method, the fermentation broth containing the isobutanol is distilled to near the azeotropic composition and then the remaining water is removed by use of an adsorbent, such as molecular sieves (Aden, et al., *Lignocellulosic Biomass to Ethanol Process Design and Economics Utilizing Co-Current Dilute Acid Prehydrolysis and Enzymatic Hydrolysis fob Corn Stover*, Report NREL/TP-510-32438, National Renewable Energy Laboratory, June 2002).

Additionally, distillation in combination with pervaporation may be used to isolate and purify isobutanol from the fermentation medium. In this method, the fermentation broth containing the isobutanol is distilled to near the azeotropic composition, and then the remaining water is removed by pervaporation through a hydrophilic membrane (Guo, et al., J. Membr. Sci. 245:199-210, 2004). Other distillation methods may be employed, including those described in U.S. Patent Application Publication No. 2011/0162953; U.S. Patent Application Publication No. 2011/0162954; U.S. Patent Application Publication No. 2011/0288345; U.S. Patent Application Publication No. 2011/0288344; and U.S. Patent Application Publication No. 2011/0315541; the entire contents of each are herein incorporated by reference.

In situ product removal (ISPR) (also referred to as extractive fermentation) may be used to remove isobutanol or other fermentative alcohols from the fermentation vessel as it is produced, thereby allowing the microorganism to produce isobutanol at high yields. One ISPR method for removing fermentative alcohols that has been described in the art is liquid-liquid extraction. In general, with regard to isobutanol fermentation, for example, the fermentation medium, which includes the microorganism, is contacted with an extractant (e.g., an organic extractant) at a time before the isobutanol concentration reaches a toxic level. The extractant and the fermentation medium form a biphasic mixture. The isobutanol partitions into the extractant phase, decreasing the concentration in the aqueous phase containing the microorganism, thereby limiting the exposure of the microorganism to the inhibitory isobutanol.

Liquid-liquid extraction may be performed, for example, according to the processes described in U.S. Patent Application Publication No. 2009/0305370, the disclosure of which is hereby incorporated in its entirety. U.S. Patent Application Publication No. 2009/0305370 describes methods for producing and recovering isobutanol from a fermentation broth using liquid-liquid extraction, the methods comprising the step of contacting the fermentation broth with a water-immiscible extractant to form a two-phase mixture comprising an aqueous phase and an organic phase. The extractant may be an organic extractant selected from the group consisting of saturated, mono-unsaturated, poly-unsaturated $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR may be non-alcohol extractants. The ISPR extractant may be an exogenous organic extractant such as oleyl alcohol, behenyl alcohol, cetyl alcohol, lauryl alcohol, myristyl alcohol, stearyl alcohol, alkyl alkanols, 1-undecanol, oleic acid, lauric acid, myristic acid, stearic acid, methyl myristate, methyl oleate, undecanal, lauric aldehyde, 20-methylundecanal, trioctyl phosphine oxide, and mixtures thereof. Other extractants and methods are described in U.S. Patent Application Publication No. 2010/0143994; U.S. Patent Application Publication No. 2010/0143995; U.S. Patent Application Publication No. 2010/0143992; U.S. Patent Application Publication No. 2010/0143993; U.S. Patent Application Publication No. 2011/0097773; U.S. Patent Application Publication No. 2011/0159558; U.S. Patent Application Publication No. 2011/0136193; the entire contents of each are herein incorporated by reference.

In some embodiments, an ester may be formed by contacting an alcohol in a fermentation medium with an organic acid (e.g., fatty acids) and a catalyst capable of esterifying the alcohol with the organic acid. In such embodiments, the organic acid may serve as an ISPR extractant into which the alcohol esters partition. The organic acid may be supplied to the fermentation vessel and/or derived from the biomass supplying fermentable carbon fed to the fermentation vessel. Lipids present in the feedstock may be catalytically hydrolyzed to organic acid, and the same catalyst (e.g., enzymes) may esterify the organic acid with the alcohol. The catalyst may be supplied to the feedstock prior to fermentation, or may be supplied to the fermentation vessel before or contemporaneously with the supplying of the feedstock. When the catalyst is supplied to the fermentation vessel, alcohol esters may be obtained by hydrolysis of the lipids into organic acid and substantially simultaneous esterification of the organic acid with the alcohol present in the fermentation vessel. Organic acid and/or native oil not derived from the feedstock may also be fed to the fermentation vessel, with the native oil being hydrolyzed into organic acid. Any organic acid not esterified with the alcohol may serve as part of the ISPR extractant. The extractant containing alcohol esters may be separated from the fermentation medium, and the alcohol may be recovered from the extractant. In some embodiments, the extractant may be recycled to the fermentation vessel. Thus, in the case of isobutanol production, for example, the conversion of isobutanol to an ester reduces the free isobutanol concentration in the fermentation medium, shielding the microorganism from the toxic effect of increasing isobutanol concentrations. In addition, unfractionated grain may be used as feedstock without separation of lipids therein, since the lipids may be catalytically hydrolyzed to organic acid, thereby decreasing the rate of build-up of lipids in the ISPR extractant. Other alcohol product recovery and/or ISPR methods may be employed, including those described in U.S. Patent Application Publication No. 2009/0305370; U.S. Patent Application Publication No. 2010/0221802; U.S. Patent Application Publication No. 2010/0279370; U.S. Patent Application Publication No. 2011/0097773; U.S. Patent Application Publication No. 2011/0312044; U.S. Patent Application Publication No. 2011/0312043; U.S. Patent Application Publication No. 2012/0035398; U.S. Patent Application Publication No. 2012/0211348; and U.S. Patent Application Publication No. 2012/0156738; the entire contents of each are herein incorporated by reference.

In situ product removal may be carried out in a batch mode or a continuous mode. In a continuous mode of ISPR, product is continually removed from the fermentation vessel (e.g., reactor). In a batchwise mode of ISPR, a volume of organic extractant is added to the fermentation vessel and the extractant is not removed during the process. For ISPR, the organic extractant may contact the fermentation medium at the start of the fermentation forming a biphasic fermentation medium. Alternatively, the organic extractant may contact the fermentation medium after the microorganism has achieved a desired amount of growth, which may be determined by measuring the optical density of the culture. Further, the organic extractant may contact the fermentation medium at a time at which the alcohol level in the fermentation medium reaches a preselected level. In the case of isobutanol production according to some embodiments of the present invention, the organic acid extractant may contact the fermentation medium at a time before the isobutanol concentration reaches a toxic level, so as to esterify the isobutanol with the organic acid to produce isobutanol esters and consequently reduce the concentration of isobutanol in the fermentation vessel. The ester-containing organic phase may then be removed from the fermentation vessel (and separated from the fermentation broth which constitutes the aqueous phase) after a desired effective titer of the isobutanol esters is achieved. In some embodiments, the ester-containing organic phase is separated from the aqueous phase after fermentation of the available fermentable sugar in the fermentation vessel is substantially complete. Isobutanol titer in any phase can be determined by methods known in the art, such as via high performance liquid chromatography (HPLC) or gas chromatography, as described, for example in U.S. Patent Application Publication No. 2009/0305370, which is incorporated herein by reference.

EXAMPLES

The present invention is further defined in the following Examples. It should be understood that these Examples, while indicating embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook, et al. (Sambrook, J., Fritsch, E. F. and Maniatis, T. (Molecular Cloning: A Laboratory Manual; Cold Spring Harbor Laboratory Press, Cold Spring Harbor, 1989) and by Ausubel, et al. (Ausubel, et al., Current Protocols in Molecular Biology, pub. by Greene Publishing Assoc. and Wiley-Interscience, 1987).

Materials and methods suitable for the maintenance and growth of bacterial cultures are well known in the art. Techniques suitable for use in the following examples may be found as set out in Manual of Methods for General Bacteriology (Phillipp, et al., eds., American Society for Microbiology, Washington, D.C., 1994) or by Thomas D. Brock in (Brock, Biotechnology: A Textbook of Industrial Microbiology, Second Edition, Sinauer Associates, Inc., Sunderland, Mass. (1989). All reagents, restriction enzymes and materials used for the growth and maintenance of bacterial cells were obtained from Sigma-Aldrich Chemicals (St. Louis, Mo.), BD Diagnostic Systems (Sparks, Md.), Invitrogen (Carlsbad, Calif.), HiMedia (Mumbai, India), SD Fine chemicals (India), or Takara Bio Inc. (Shiga, Japan), unless otherwise specified.

The meaning of abbreviations is as follows: "sec" means second(s), "min" means minute(s), "h" means hour(s), "nm" means nanometers, "uL" means microliter(s), "mL" means milliliter(s), "mg/mL" means milligram per milliliter, "L" means liter(s), "nm" means nanometers, "mM" means millimolar, "M" means molar, "mmol" means millimole(s), "µmole" means micromole(s), "kg" means kilogram, "g" means gram(s), "µg" means microgram(s) and "ng" means nanogram(s), "PCR" means polymerase chain reaction, "OD" means optical density, "$OD_{600}$" means the optical density measured at a wavelength of 600 nm, "kDa" means kilodaltons, "g" can also mean the gravitation constant, "bp" means base pair(s), "kbp" means kilobase pair(s), "kb" means kilobase, "%" means percent, "% w/v" means weight/volume percent, "% v/v" means volume/volume percent, "HPLC" means high performance liquid chromatography, "g/L" means gram per liter, "µg/L" means microgram per liter, "ng/µL" means nanogram per microliter, "pmol/µL" means picomol per microliter, "RPM" means rotation per minute, "µmol/min/mg" means micromole per minute per milligram, "w/v" means weight per volume, "v/v" means volume per volume.

Example 1

Construction of a *Saccharomyces cerevisiae* Strain with a PDE1 Deletion

The strain PNY1500 was derived from CEN.PK 113-7D (CBS 8340; Centraalbureau voor Schimmelcultures (CBS) Fungal Biodiversiry Centre, Netherlands) and contains deletions of the URA3 and HIS3 genes.
URA3 Deletion To delete the endogenous URA3 coding region, a ura3::loxP-kanMX-loxP cassette was PCR-amplified from pLA54 template DNA (SEQ ID NO: 132). pLA54 contains the *K. lactis* TEF1 promoter and kanMX marker, and is flanked by loxP sites to allow recombination with Cre recombinase and removal of the marker. PCR was done using Phusion® DNA polymerase (New England BioLabs Inc., Ipswich, Mass.) and primers BK505 and BK506 (SEQ ID NOs: 133 and 134). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G-418 (Geneticin®, 100 µg/mL) at 30° C. Transformants were screened to verify correct integration by PCR using primers LA468 and LA492 (SEQ ID NOs: 135 and 136) and designated CEN.PK 113-7D ura3Δ::kanMX.
HIS3 Deletion The HIS3 deletion was made by a scarless deletion procedure adapted from Akada, et al., (Yeast 23:399-405, 2006). A PCR cassette for the scarless deletion was made by combining four fragments, A-B-U-C, by overlapping PCR. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C, each 500 bp long, corresponded to the 500 bp immediately upstream of the target gene (Fragment A) and the 3' 500 bp of the target gene (Fragment C). Fragments A and C were used for integration of the cassette into the chromosome by homologous recombination. Fragment B (500 bp long) corresponded to the 500 bp immediately downstream of the target gene and was used for excision of the URA3 marker and Fragment C from the chromosome by homologous recombination, as a direct repeat of the sequence corresponding to Fragment B was created upon integration of the cassette into the chromosome.

The four fragments for the PCR cassette for the scarless HIS3 deletion were amplified using Phusion® High Fidelity PCR Master Mix (New England BioLabs Inc.; Ipswich, Mass.) and CEN.PK 113-7D genomic DNA as template, prepared with a Gentra® Puregene® Yeast/Bact. kit (Qiagen, Valencia, Calif.). HIS3 Fragment A was amplified with primer oBP452 (SEQ ID NO: 137) and primer oBP453 (SEQ ID NO: 138), containing a 5' tail with homology to the 5' end of HIS3 Fragment B. HIS3 Fragment B was amplified with primer oBP454 (SEQ ID NO: 139), containing a 5' tail with homology to the 3' end of HIS3 Fragment A, and primer oBP455 (SEQ ID NO: 140), containing a 5' tail with homology to the 5' end of HIS3 Fragment U. HIS3 Fragment U was amplified with primer oBP456 (SEQ ID NO: 141), containing a 5' tail with homology to the 3' end of HIS3 Fragment B, and primer oBP457 (SEQ ID NO: 142), containing a 5' tail with homology to the 5' end of HIS3 Fragment C. HIS3 Fragment C was amplified with primer oBP458 (SEQ ID NO: 143), containing a 5' tail with homology to the 3' end of HIS3 Fragment U, and primer oBP459 (SEQ ID NO: 144). PCR products were purified with a PCR Purification kit (Qiagen, Valencia, Calif.). HIS3 Fragment AB was created by overlapping PCR by mixing HIS3 Fragment A and HIS3 Fragment B and amplifying with primers oBP452 (SEQ ID NO: 137) and oBP455 (SEQ ID NO: 140). HIS3 Fragment UC was created by overlapping PCR by mixing HIS3 Fragment U and HIS3 Fragment C and amplifying with primers oBP456 (SEQ ID NO: 141) and oBP459 (SEQ ID NO: 144). The resulting PCR products were purified on an agarose gel followed by a Gel Extraction kit (Qiagen, Valencia, Calif.). The HIS3 ABUC cassette was created by overlapping PCR by mixing HIS3 Fragment AB and HIS3 Fragment UC and amplifying with primers oBP452 (SEQ ID NO: 137) and oBP459 (SEQ ID NO: 144). The PCR product was purified with a PCR Purification kit (Qiagen, Valencia, Calif.).

Competent cells of CEN.PK 113-7D ura3Δ::kanMX were made and transformed with the HIS3 ABUC PCR cassette using a Frozen-EZ Yeast Transformation II™ kit (Zymo Research Corporation, Irvine, Calif.). Transformation mixtures were plated on synthetic complete media lacking uracil supplemented with 2% glucose at 30° C. Transformants with a his3 knock-out were screened for by PCR with primers oBP460 (SEQ ID NO: 145) and oBP461 (SEQ ID NO: 146) using genomic DNA prepared with a Gentra® Puregene® Yeast/Bact. kit. (Qiagen, Valencia, Calif.). A correct transformant was selected as strain CEN.PK 113-7D ura3Δ::kanMX his3Δ::URA3.
KanMX Marker Removal from ura3Δ Site and URA3 Marker Removal from his3Δ Site The KanMX marker was removed by transforming CEN.PK 113-7D ura3Δ::kanMX his3Δ::URA3 with pRS423::P$_{GAL1}$-cre (SEQ ID NO: 147) using a Frozen-EZ Yeast Transformation II™ kit (Zymo Research Corporation, Irvine, Calif.) and plating on synthetic complete medium lacking histidine and uracil supplemented with 2% glucose at 30° C. Transformants were grown in YP supplemented with 10 g/L galactose at 30° C. for ~6 hours to induce the CRE recombinase and KanMX marker excision and plated onto YPD (20 g/L glucose) plates at 30° C. for recovery. An isolate was grown overnight in YPD and plated on synthetic complete medium containing 5-fluoro-orotic acid (5-FOA, 1 g/L) at 30° C. to select for isolates that lost the URA3 marker. 5-FOA resistant isolates were grown in and plated on YPD for removal of the pRS423::P$_{GAL1}$-cre (SEQ ID NO: 147) plasmid. Isolates were checked for loss of the KanMX marker, URA3 marker, and pRS423::P$_{GAL1}$-cre plasmid by assaying growth on YPD+G-418 plates, synthetic complete medium lacking uracil plates, and synthetic complete medium lacking histidine plates. A correct isolate that was sensitive to G-418 and auxotrophic for uracil and histidine was selected as strain CEN.PK 113-7D ura3Δ::loxP his3Δ and designated as PNY1500 (BP857). The deletions and marker removal were confirmed by PCR and sequencing with primers oBP450 (SEQ ID NO: 148) and oBP451 (SEQ ID NO: 149) for ura3Δ and primers oBP460 (SEQ ID NO: 145) and oBP461 (SEQ ID NO: 146) for his3Δ using genomic DNA prepared with a Gentra® Puregene® Yeast/Bact. kit (Qiagen, Valencia, Calif.).

Gene deletion was made in the PNY01500 haploid strains. Chromosomal gene deletion was created by homologous recombination with a cassette containing homology upstream and downstream of the target gene. Transformants were selected using either G-418 resistance marker or growth on uracil deficient medium. Gene disruption cassette was generated by PCR using specific primers with 50-55 bp flank of upstream and downstream of gene to be disrupted. Marker recycling was achieved using the Cre-lox system.

To delete the endogenous PDE1 coding region, a deletion cassette was PCR-amplified from pLA59 (SEQ ID NO: 150) which contains URA3p-URA3-URA3t cassette flanked by degenerate loxP71 and loxP66 sites for removal of the URA3 marker. PCR was performed using Phusion® DNA polymerase (New England BioLabs Inc., Ipswich, Mass.) and primers PDE1 F URA3 (SEQ ID NO: 151) and PDE1 R URA3 (SEQ ID NO: 152). The PCR product was transformed into PNY01500 using standard genetic techniques (Methods in Yeast Genetics, 2005, Cold Spring Harbor Laboratory Press, Cold Spring Harbor, N.Y., pp. 201-202) with selection on synthetic complete media (1× yeast nitrogen base without amino acids, 1× amino acid mix lacking uracil supplemented with 20 g/L glucose) at 30° C. Transformants were screened by colony PCR with primers URA IR and PDE1F (SEQ ID NOs: 153 and 154) to verify presence of the integration cassette, and primers URA1F and PDE1R (SEQ ID NOs: 155 and 156). To remove URA3 marker of the cassette cells were transformed with pRS423::GAL1p-cre (SEQ ID NO: 147) and transformants were selected on synthetic complete media (1× yeast nitrogen base, 1× amino acid mix histidine drop out supplemented with 20 g/L glucose) lacking histidine at 30° C. Transformants were plated on yeast extract+peptone (YP) agar plate supplemented with 5 g/L galactose to induce expression of Cre-recombinase. Marker removal was confirmed by patching colonies to synthetic complete media lacking uracil and supplemented with 20 g/L glucose to verify absence of growth. Deletion and marker removal also confirmed by PCR and sequencing with primers PDE1F and PDE1R (SEQ ID NOs: 154 and 156) using genomic DNA prepared with Gentra® Puregene® Yeast/Bact. kit (Qiagen, Valencia, Calif.). The resulting PDE1 deletion strain of PNY01500 named PNY03001 (MATa ura3Δ::loxP his3Δ pde1Δ::loxp71/66).

Example 2

Construction of Strains for Isobutanol Production

The yeast strain PNY860 (ATCC Patent Deposit Designation PTA-12007, deposited on Jul. 21, 2011) was tested for sporulation competence (Codón, et al., Appl. Environ. Microbiol. 61:630-638, 1995) by growth overnight at 30° C. in 2 mL pre-sporulation medium (0.8% yeast extract, 0.3% peptone, 10% glucose) in a roller drum, followed by 1:10 dilution into fresh pre-sporulation medium and further growth for 4 hr. Cells were recovered by centrifugation and resuspended in 2 mL sporulation medium (0.5% potassium acetate) and incubated for 4 days in a roller drum at 30° C. Microscopic examination revealed that sporulation had occurred. Approximately 30% of the cells were in the form of asci, and about half of the asci contained four spores. The sporulation culture (100 µL) was recovered by centrifugation and resuspended in Zymolyase® (50 µg/mL in 1 M sorbitol), and incubated for 20 min at room temperature. An aliquot (5 µL) was transferred to a Petri plate, and 18 tetrads were dissected using a Singer MSM dissection microscope (Singer Instrument Co. Ltd., Somerset UK) according to the manufacturer's instructions. The plate was incubated 3 days at 30° C. and the spore viability was scored. FIG. 1 shows the tetrad dissection plate.

To identify mating types, four spore colonies from two tetrads were analyzed by colony PCR (see, e.g., Huxley, et al., Trends Genet. 6:236, 1990) using Phusion® High Fidelity PCR Master Mix (New England BioLabs Inc.; Ipswich, Mass.) with three oligonucleotide primers, AK09-1_MAT (SEQ ID NO: 272), AK09-2_HML (SEQ ID NO: 273), and AK09-03_HMR (SEQ ID NO: 274).

Figure 2:
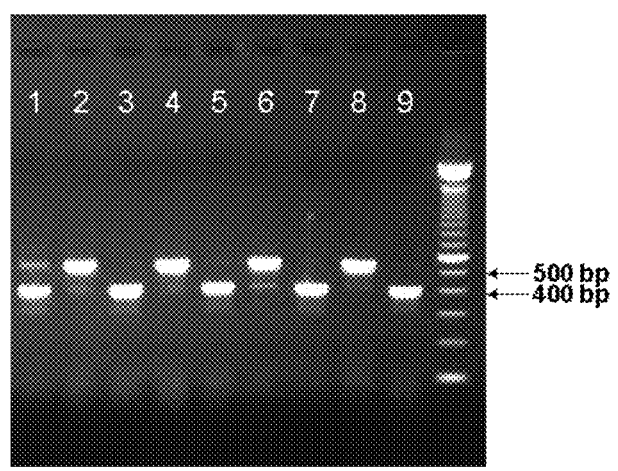
FIG. 2 depicts an agarose gel with PCR products from a mating type analysis of 4 colonies from 2 tetrads that are spore progeny of PNY860. Lane 1 is PNY860. Lane 2 is PNY860-1A. Lane 3 is PNY860-1B. Lane 4 is PNY860-1C. Lane 5 is PNY860-1D. Lane 6 is PNY860-2A. Lane 7 is PNY860-2B. Lane 8 is PNY860-2C. Lane 9 is PNY860-2D.
Figure 3:
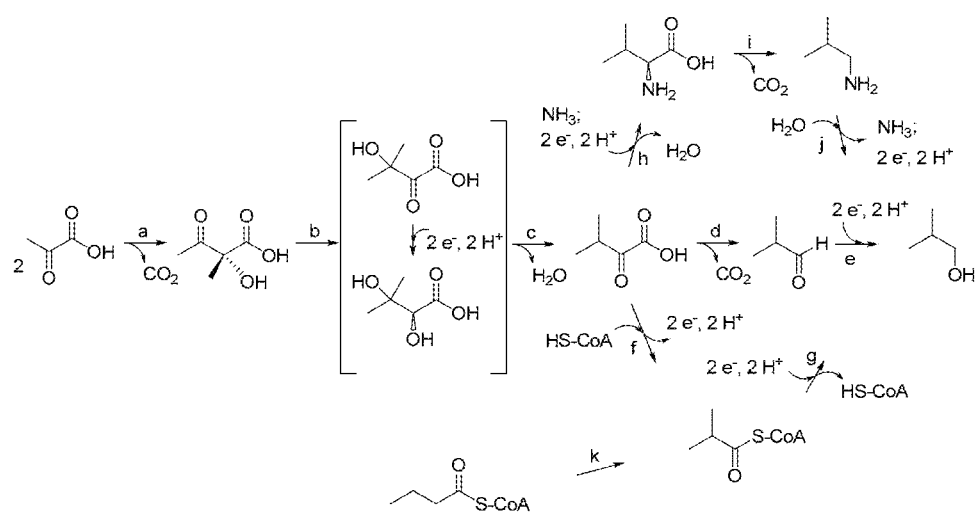
FIG. 3 depicts different isobutanol biosynthetic pathways. The steps labeled "a," "b," "c," "d," "e," "f," "g," "h," "I," "j," and "k" represent substrate to product conversions described below. For example, "a" may be catalyzed by acetolactate synthase; "b" may be catalyzed, for example, by acetohydroxyacid reductoisomerase; "c" may be catalyzed, for example, by acetohydroxy acid dehydratase; "d" may be catalyzed, for example, by branched-chain keto acid decarboxylase; "e" may be catalyzed, for example, by branched chain alcohol dehydrogenase; "f" may be catalyzed, for example, by branched chain keto acid dehydrogenase; "g" may be catalyzed, for example, by acetylating aldehyde dehydrogenase; "h" may be catalyzed, for example, by transaminase or valine dehydrogenase; "i" may be catalyzed, for example, by valine decarboxylase; "j" may be catalyzed, for example, by omega transaminase; and "k" may be catalyzed, for example, by isobutyryl-CoA mutase.
Figure 4:
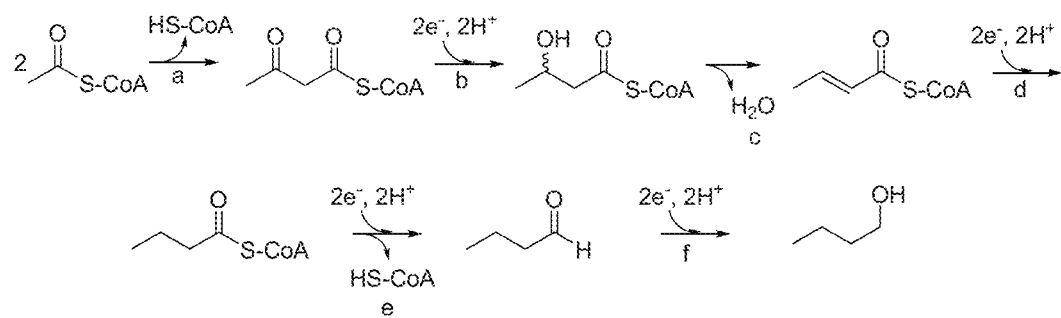
FIG. 4 depicts the 1-butanol biosynthetic pathway. The steps labeled "a," "b," "c," "d," "e," and "f" represent substrate to product conversions described below. For example, "a" may be catalyzed by acetyl-CoA acetyl transferase; "b" may be catalyzed, for example, by 3-hydroxybutyryl-CoA dehydrogenase; "c" may be catalyzed, for example, by crotonase; "d" may be catalyzed, for example, by butyryl-CoA dehydrogenase; "e" may be catalyzed, for example, by butyraldehyde dehydrogenase; and "f" may be catalyzed, for example, by butanol dehydrogenase.
Figure 5:
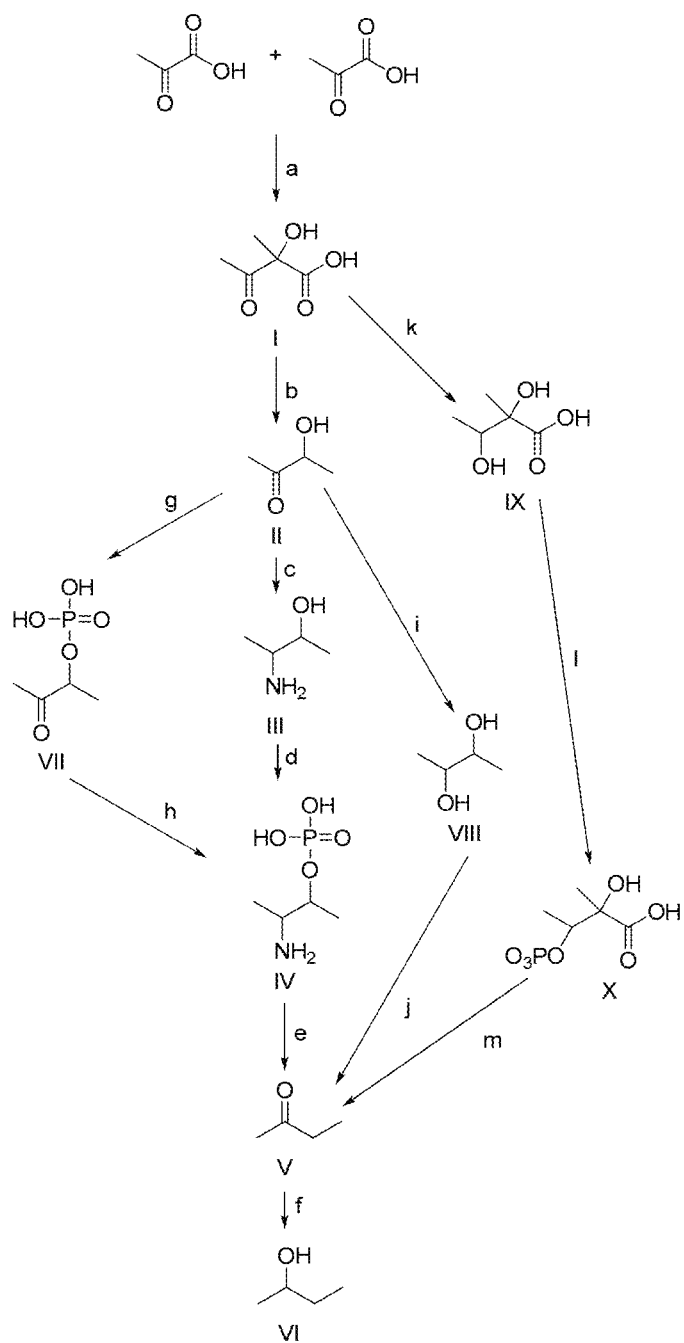
FIG. 5 depicts the 2-butanol and 2-butanone biosynthetic pathways.

Cells from colonies were lysed by suspension in 0.02 M NaOH and heating to 99° C. for 10 min. A portion of this lysate was then used as the template in a PCR reaction using Taq polymerase (Promega, Madison Wis.) as recommended by the manufacturer. PCR products were analyzed by agarose gel electrophoresis. Strains of mating type a are expected to generate a 404 bp product, strains of mating type a are expected to produce a 544 bp product, and diploids should produce both bands. FIG. 2 shows that the parental strain, PNY860, produces two bands, and the spore progeny produce only one prominent band, of ~400 bp or ~550 bp (although some produced faint bands of the other size). These results suggest that PNY860 is a diploid and is largely heterothallic (although a low level of mating type switching may have occurred).

Based on the PCR fragment sizes, the mating types can be inferred to be as follows in Table 4:

TABLE 4

| Yeast Strain | Mating Type |
| --- | --- |
| PNY860 | Diploid |
| PNY860-1A | a |
| PNY860-1B | α |
| PNY860-1C | a |
| PNY860-1D | α |
| PNY860-2A | a |
| PNY860-2B | α |
| PNY860-2C | a |
| PNY860-2D | α |

To confirm these assignments, spores from tetrad 1 (PNY860-1) were crossed, and mating was scored by looking for zygote formation by microscopy, with the following results in Table 5:

TABLE 5

| Cross | Expected | Observed |
| --- | --- | --- |
| A × B | Mate | Mate |
| C × D | Mate | Mate |
| A × C | No mate | No mate |
| C × D | No mate | No mate |

The yeast strains were designated as follows: PNY860-1A was designated as PNY891, PNY860-1B was designated as PNY0892, PNY860-1C was designated as PNY893, and PNY860-1D was designated as PNY0894.

The haploid strains (PNY891 MATa and PNY0894 MATα) were chosen as a host for isobutanol production. Gene deletion and integration were performed in the haploid strains to create a strain background suitable for isobutanol production. Chromosomal gene deletion was performed by homologous recombination with a PCR cassette containing homology upstream and downstream of the target gene, and either a G-418 resistance marker or URA3 gene for selection of transformants. For gene integration, the gene to be integrated was included in the PCR cassette. The selective marker recycle was achieved using either the Cre-lox system or a scarless deletion method (Akada, et al., Yeast 23: 399, 2006).

First, gene deletion (URA3, HIS3, PDC6, and PDC1) and integration (ilvD into the PDC1 site) were performed in the PNY891 MATa to generate PNY1703 (=MATa ura3Δ::loxP his3Δ::loxP pdc6Δ pdc1Δ::ilvD). Second, PNY1703 was mated with PNY0894 MATα to make a diploid. The resulting diploid was sporulated and then tetrad-dissected, and spore segregants were screened for growth phenotype on glucose and ethanol media, and genotype carrying ura3Δ::loxP his3Δ::loxP pdc6Δ pdc1Δ::ilvD. Two mating type haploids, PNY1713 (=MATa ura3Δ::loxP his3Δ::loxP pdc6Δ pdc1Δ::ilvD) and PNY1714 (=MATα ura3::loxP his3::loxP pdc6Δ pdc1Δ::ilvD) were isolated. Third, gene deletion (PDC5, FRA2, GPD2, BDH1, and YMR226c) and integration (kivD, ilvD, alsS, and ilvD-adh into the PDC5, FRA2, GPD2, and BDH1 sites, respectively) were performed in the PNY1714 strain background to construct PNY1758 (=MATa ura3Δ::loxP his3Δ::loxP pdc6Δ pdc1Δ::ilvD pdc5::kivD(y) fra2Δ:: UAS(PGK1)-FBA1p-ilvD(y)gpd2Δ::loxP71/66-FBA1p-alsS bdh1Δ:: UAS(PGK1)-ENO2p-ilvD-ILV5p-adh ymr226cΔ). Fourth, PNY1758 was transformed with two plasmids, pWZ009 (SEQ ID NO: 158) containing K9D3.KARI gene and pWZ001 (SEQ ID NO: 159) containing ilvD gene, to construct the cane isobutanologen, PNY1775 (=MATa ura3Δ::loxP his3Δ::loxP pdc6Δ pdc1Δ:: ilvD pdc5Δ::kivD(y) fra2Δ:: UAS(PGK1)-FBA1p-ilvD(v) gpd2Δ::loxP71/66-FBA1p-alsS bdh1Δ::UAS(PGK1)-ENO2p-ilvD-ILV5p-adh ymr226cΔ/pWZ009, pWZ001).

URA3 Deletion

To delete the endogenous URA3 coding region, a deletion cassette was PCR-amplified from pLA54 (SEQ ID NO: 132) which contains a TEF1p-kanMX-TEF1t cassette flanked by loxP sites to allow homologous recombination in vivo and subsequent removal of the KanMX marker. PCR was performed using Phusion® DNA polymerase (New England BioLabs Inc., Ipswich, Mass.) and primers BK505 (SEQ ID NO: 133) and BK506 (SEQ ID NO: 134). The URA3 portion of each primer was derived from the 5' region 180 bp upstream of the URA3 ATG and 3' region 78 bp downstream of the coding region such that integration of the KanMX cassette results in replacement of the URA3 coding region. The PCR product was transformed into PNY891, a haploid strain, using standard genetic techniques (Methods in Yeast Genetics, 2005, Cold Spring Harbor Laboratory Press, Cold Spring Harbor, N.Y., pp. 201-202) and transformants were selected on rich media supplemented with 2% glucose and G-418 (Geneticin®, 100 μg/mL) at 30° C. Transformants were patched onto rich media supplemented with 2% glucose and replica plated onto synthetic complete media lacking uracil and supplemented with 2% glucose to identify uracil auxotrophs. These patches were screened by colony PCR with primers LA468 (SEQ ID NO: 135) and LA492 (SEQ ID NO: 136) to verify presence of the integration cassette. A URA3 mutant was obtained; NYLA96 (=MATa ura3Δ::loxP-kanMX-loxP).

HIS3 Deletion

To delete the endogenous HIS3 coding region, a deletion cassette was PCR-amplified from pLA33 (SEQ ID NO: 160) which contains a URA3p-URA3-URA3t cassette flanked by loxP sites to allow homologous recombination in vivo and subsequent removal of the URA3 marker. PCR was performed using Phusion® DNA polymerase (New England BioLabs Inc., Ipswich, Mass.) and primers 315 (SEQ ID NO: 161) and 316 (SEQ ID NO: 162). The HIS3 portion of each primer was derived from the 5' region 50 bp upstream of the HIS3 ATG and 3' region 50 bp downstream of the coding region such that integration of the URA3 cassette results in replacement of the HIS3 coding region. The PCR product was transformed into NYLA96 using standard genetic techniques (Methods in Yeast Genetics, 2005, Cold Spring Harbor Laboratory Press, Cold Spring Harbor, N.Y., pp. 201-202) with selection on synthetic complete media lacking uracil supplemented with 2% glucose at 30° C. Transformants were screened by colony PCR with primers 92 (SEQ ID NO: 163) and 346 (SEQ ID NO: 164) to verify presence of the integration cassette. The URA3 marker was recycled by transforming with pRS423::GAL1p-cre (SEQ ID NO: 147) and plated on synthetic complete media lacking histidine and supplemented with 2% glucose at 30° C. Transformants were plated on yeast extract+peptone (YP) agar plate supplemented with 0.5% galactose to induce expression of Cre recombinase. Marker removal was confirmed by patching colonies to synthetic complete media lacking uracil and supplemented with 2% glucose to verify absence of growth. Also, marker removal of the KanMX cassette, used to delete URA3, was confirmed by patching colonies to rich media supplemented with 2% glucose and G-418 (Geneticin®, 100 μg/mL) at 30° C. to verify absence of growth. The resulting URA3 and HIS3 deletion strain was named NYLA107 (=MATa ura3Δ::loxP his3Δ::loxP).

PDC6 Deletion

*Saccharomyces cerevisiae* has three PDC genes (PDC1, PDC5, PDC6), encoding three different isozymes of pyruvate decarboxylase. Pyruvate decarboxylase catalyzes the first step in ethanol fermentation, producing acetaldehyde from the pyruvate generated in glycolysis.

The PDC6 coding sequence was deleted by homologous recombination with a PCR cassette (A-B-U-C) containing homology upstream (fragment A) and downstream (fragment B) of the PDC6 coding region, a URA3 gene along with the promoter (250 bp upstream of the URA3 gene) and terminator (150 bp downstream of the URA3 gene) (fragment U) for selection of transformants, and the 3' region of the PDC6 coding region (fragment C), according to a scarless deletion method (Akada, et al., Yeast 23: 399, 2006). The four fragments (A, B, U, C) for the PCR cassette for the scarless PDC6 deletion were amplified from PNY891 genomic DNA as template using Phusion® High Fidelity PCR Master Mix (New England BioLabs Inc.; Ipswich, Mass.). PNY891 genomic DNA was prepared with a Gentra® Puregene® Yeast/Bact. kit (Qiagen, Valencia, Calif.). PDC6 Fragment A was amplified with primer oBP440 (SEQ ID NO: 165) and primer oBP441 (SEQ ID NO: 166), containing a 3' tail with homology to the 5' end of PDC6 Fragment B. PDC6 Fragment B was amplified with primer oBP442 (SEQ ID NO: 167), containing a 5' tail with homology to the 3' end of PDC6 Fragment A, and primer oBP443 (SEQ ID NO: 168), containing a 5' tail with homology to the 5' end of PDC6 Fragment U. PDC6 Fragment U was amplified with primer oBP444 (SEQ ID NO: 169), containing a 5' tail with homology to the 3' end of PDC6 Fragment B, and primer oBP445 (SEQ ID NO: 170), containing a 5' tail with homology to the 5' end of PDC6 Fragment C. PDC6 Fragment C was amplified with primer oBP446 (SEQ ID NO: 171), containing a 5' tail with homology to the 3' end of PDC6 Fragment U, and primer oBP447 (SEQ ID NO: 172). PCR products were purified with a PCR purification kit (Qiagen, Valencia, Calif.). PDC6 Fragment A-B was created by overlapping PCR by mixing PDC6 Fragment A and PDC6 Fragment B and amplifying with primers oBP440 (SEQ ID NO: 165) and oBP443 (SEQ ID NO: 168). PDC6 Fragment U-C was created by overlapping PCR by mixing PDC6 Fragment U and PDC6 Fragment C and amplifying with primers oBP444 (SEQ ID NO: 169) and oBP447 (SEQ ID NO: 172). The resulting PCR products were gel-purified on an agarose gel followed by a gel extraction kit (Qiagen, Valencia, Calif.). The PDC6 A-B-U-C cassette was created by overlapping PCR by mixing PDC6 Fragment A-B and PDC6 Fragment U-C and amplifying with primers oBP440 (SEQ ID NO: 165) and oBP447 (SEQ ID NO: 172). The PCR product was purified with a PCR purification kit (Qiagen, Valencia, Calif.).

Competent cells of NYLA107 were made and transformed with the PDC6 A-B-U-C PCR cassette using a Frozen-EZ Yeast Transformation II™ kit (Zymo Research Corporation, Irvine, Calif.). Transformation mixtures were plated on synthetic complete media lacking uracil supplemented with 2% glucose at 30° C. Transformants with a pdc6 knockout were screened for by PCR with primers oBP448 (SEQ ID NO: 173) and oBP449 (SEQ ID NO: 174) using genomic DNA prepared with a Gentra® Puregene® Yeast/Bact. kit (Qiagen, Valencia, Calif.). To remove the URA3 marker from the chromosome, a correct transformant was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO: 173) and oBP449 (SEQ ID NO: 174) using genomic DNA prepared with a Gentra® Puregene® Yeast/Bact. kit (Qiagen, Valencia, Calif.). The absence of the PDC6 gene from the isolate was demonstrated by a negative PCR result using primers specific for the coding sequence of PDC6, oBP554 (SEQ ID NO: 175) and oBP555 (SEQ ID NO: 176). The correct isolate was selected as strain PNY1702 (=MATa ura3Δ::loxP his3Δ::loxP pdc6Δ).

PDC1 Deletion and ilvD Integration

The PDC1 coding region was deleted and replaced with the ilvD coding region from *Streptococcus mutans* ATCC No. 700610 by homologous recombination with a PCR cassette (A-ilvD-B-U-C) containing homology upstream (fragment A) and downstream (fragment B) of the PDC1 coding region, the ilvD coding region (fragment ilvD), a URA3 gene along with the promoter and terminator (fragment U) for selection of transformants, and the 3' region of the PDC1 coding region (fragment C). The A fragment followed by the ilvD coding region from *Streptococcus mutans* for the PCR cassette for the PDC1 deletion-ilvD integration was amplified using Phusion® High Fidelity PCR Master Mix (New England BioLabs Inc.; Ipswich, Mass.) and NYLA83 (described in U.S. Patent Application Publication No. 2011/0312043, which is incorporated herein by reference) genomic DNA as template, prepared with a Gentra® Puregene® Yeast/Bact. kit (Qiagen, Valencia, Calif.). PDC1 Fragment A-ilvD was amplified with primer oBP513 (SEQ ID NO: 177) and primer oBP515 (SEQ ID NO: 178), containing a 5' tail with homology to the 5' end of PDC1 Fragment B. The B, U, and C fragments for the PCR cassette for the PDC1 deletion-ilvD integration were amplified using Phusion® High Fidelity PCR Master Mix (New England BioLabs Inc.; Ipswich, Mass.) and PNY891 genomic DNA as template, prepared with a Gentra® Puregene® Yeast/Bact. kit (Qiagen, Valencia, Calif.). PDC1 Fragment B was amplified with primer oBP516 (SEQ ID NO: 179), containing a 5' tail with homology to the 3' end of PDC1 Fragment A-ilvD, and primer oBP517 (SEQ ID NO: 180), containing a 5' tail with homology to the 5' end of PDC1 Fragment U. PDC1 Fragment U was amplified with primer oBP518 (SEQ ID NO: 181), containing a 5' tail with homology to the 3' end of PDC1 Fragment B, and primer oBP519 (SEQ ID NO: 182), containing a 5' tail with homology to the 5' end of PDC1 Fragment C. The PDC1 Fragment C was amplified with primer oBP520 (SEQ ID NO: 183), containing a 5' tail with homology to the 3' end of PDC1 Fragment U, and primer oBP521 (SEQ ID NO: 184). PCR products were purified with a PCR purification kit (Qiagen, Valencia, Calif.). PDC1 Fragment A-ilvD-B was created by overlapping PCR by mixing PDC1 Fragment A-ilvD and PDC1 Fragment B and amplifying with primers oBP513 and oBP517. PDC1 Fragment U-C was created by overlapping PCR by mixing PDC Fragment U and PDC1 Fragment C and amplifying with primers oBP518 (SEQ ID NO: 181) and oBP521 (SEQ ID NO: 184). The resulting PCR products were gel-purified on an agarose gel followed by a gel extraction kit (Qiagen, Valencia, Calif.). The PDC1 A-ilvD-B-U-C cassette was created by overlapping PCR by mixing PDC Fragment A-ilvD-B and PDC1 Fragment U-C and amplifying with primers oBP513 (SEQ ID NO: 177) and oBP521 (SEQ ID NO: 184). The PCR product was purified with a PCR purification kit (Qiagen, Valencia, Calif.).

Competent cells of PNY1702 were made and transformed with the PDC1 A-ilvD-B-U-C PCR cassette using a Frozen-EZ Yeast Transformation II™ kit (Zymo Research Corporation, Irvine, Calif.). Transformation mixtures were plated on synthetic complete media lacking uracil supplemented with 2% glucose at 30 C. Transformants with a pdc1 knockout ilvD integration were screened for by PCR with primers oBP511 (SEQ ID NO: 185) and oBP512 (SEQ ID NO: 186) using genomic DNA prepared with a Gentra® Puregene® Yeast/Bact. kit (Qiagen, Valencia, Calif.). The absence of the PDC1 gene from the isolate was demonstrated by a negative PCR result using primers specific for the coding sequence of PDC1, oBP550 (SEQ ID NO: 187) and oBP551 (SEQ ID NO: 188). To remove the URA3 marker from the chromosome, a correct transformant was grown overnight in YPD and plated on synthetic complete medium containing 5-fluoro-orotic acid (0.1%) at 30° C. to select for isolates that lost the URA3 marker. The deletion of PDC1, integration of ilvD, and marker removal were confirmed by PCR with primers ilvDSm(1354F) (SEQ ID NO: 189) and oBP512 (SEQ ID NO: 186) and sequencing with primers ilvDSm(788R) (SEQ ID NO: 190) and ilvDSm (1354F) (SEQ ID NO: 189) using genomic DNA prepared with a Gentra® Puregene® Yeast/Bact. kit (Qiagen, Valencia, Calif.). The correct isolate was selected as strain PNY1703 (=MATa ura3Δ::loxP his3Δ::loxP pdc6Δ pdc1Δ:: ilvD).

PNY1703 MATa×PNY0894 MATα mating, sporulation, and tetrad dissection to isolate PNY1713 (=MATα ura3Δ:: loxP his3Δ::loxP pdc6Δ pdc1Δ::ilvD) and PNY1714 (=MATa ura3Δ::loxP his3Δ::loxP pdc6Δ pdc1Δ::ilvD).

Diploid (MATa/α) cells were created by crossing PNY1703 MATa and PNY0894 MATα on YPD at 30° C. overnight. Potential diploids were streaked onto an YPD plate and incubated at 30° C. for 4 days to isolate single colonies. To identify diploid, colony PCR (Huxley, et al., Trends Genet. 6:236, 1990) was carried out using Phusion® High Fidelity PCR Master Mix (New England BioLabs Inc.; Ipswich, Mass.) with three oligonucleotide primers, MAT1 (SEQ ID NO: 191) corresponding to a sequence at the right of and directed toward the MAT locus, MAT2 (SEQ ID NO: 192) corresponding to a sequence within the α-specific region located at MATα and HMLα, and MAT3 (SEQ ID NO: 193) corresponding to a sequence within the a-specific region located at MATa and HMRa. Diploid colonies were determined by yielding two PCR products, MATα-specific 404 bp and MATa-specific 544 bp. The resulting diploids were grown in pre-sporulation medium and then inoculated into sporulation medium (Codón, et al., Appl Environ Microbiol. 61:630, 1995). After 3 days, the sporulation efficiency was checked by microscope. Spores were digested with 0.05 mg/mL Zymolyase® (Zymo Research Corporation, Irvine, Calif.; using the procedure from Methods in Yeast Genetics, 2000, Cold Spring Harbor Laboratory Press, Cold Spring Harbor, N.Y.). Eight (8) plates of tetrads were dissected (18 tetrads per plate, totaling 144 tetrads, 576 spores) on YPD plates and placed at 30° C. for 4 days. To screen the spore progeny for genotype ura3d and his3d and growth phenotype on ethanol and glucose media, the spores on YPD plates were sequentially replica plated to 1) the synthetic complete (SC) media lacking uracil (ura) supplemented with 2% glucose, 2) SC lacking histidine (his) supplemented with 2% glucose, and then 3) SC supplemented with 0.5% ethanol media using a yeast replica plating apparatus (Corastyles, Hendersonville, N.C.). Spores that failed to grow on SC-ura and SC-his plates, but grew on SC+0.5% ethanol and YPD plates were selected and PCR-analyzed to determine their mating-type (Huxley, et al., Trends Genet. 6:236, 1990). To determine if the spores contain pdc1Δ::ilvD, the selected spores were checked by colony PCR using primers oBP512 (SEQ ID NO: 186) and ilvDSm(1354F) (SEQ ID NO: 189). Spores containing pdc1Δ::ilvD produce an expected PCR product of 962 bp, but those without the deletion produce no PCR product. The positive spores were then PCR-checked for the deletion of PDC6 using primers BP448 (SEQ ID NO: 173) and BP449 (SEQ ID NO: 174). The expected PCR sizes of the fragments were 1.3 kbp for cells containing the pdc6d and 2.9 kbp for cells containing the wild-type PDC6 gene. The correct isolates were selected for both mating types, and designated as PNY1713 (=MATα ura3α::loxP his3Δ::loxP pdc6Δ pdc1Δ::ilvD) and PNY1714 (=MATα ura3Δ::loxP his3ΔΔ::loxP pdc6Δ pdc1Δ::ilvD).

PDC5 Deletion and kivD(v) Integration

The PDC5 coding region was deleted and replaced with the kivD coding region from *Lactococcus lactis* by homologous recombination with a PCR cassette (A-kivD(y)-B-U-C) containing homology upstream (fragment A) and downstream (fragment B) of the PDC5 coding region, the kivD(y) coding region (fragment kivD(y)), codon optimized for expression in *Saccharomyces cerevisiae*, a URA3 gene along with the promoter and terminator (fragment U) for selection of transformants, and the 3' region of the PDC5 coding region (fragment C).

PDC5 Fragment A was amplified from PNY891 genomic DNA as template using Phusion® High Fidelity PCR Master Mix (New England BioLabs Inc.; Ipswich, Mass.) with primer T-A(PDC5) (SEQ ID NO: 194) and primer B-A (kivD) (SEQ ID NO: 195), containing a 3' tail with homology to the 5' end of kivD(y). The coding sequence of kivD(y) was amplified from (SEQ ID NO: 196) as template with primer T-kivD(A) (SEQ ID NO: 197), containing a 5' tail with homology to the 3' end of PDC5 Fragment A, and primer B-kivD(B) (SEQ ID NO: 198), containing a 3' tail with homology to the 5' end of PDC5 Fragment B. PDC5 Fragment A-kivD(y) was created by overlapping PCR by mixing PDC5 Fragment A and kivD(y) and amplifying with primers T-A(PDC5) and B-A(kivD). PDC5 Fragment B was cloned into pUC19-URA3MCS to create the B-U portion of the PDC5 A-kivD(y)-B-U-C PCR cassette. The resulting plasmid was designated as pUC19-URA3-sadB-PDC5fragmentB (SEQ ID NO: 199). A plasmid pUC19-URA3-sadB-PDC5fragmentB was used as a template for amplification of PDC5 Fragment B-Fragment U using primers T-B(kivD) (SEQ ID NO: 200), containing a 5' tail with homology to the 3' end of kivD(y) Fragment, and oBP546 (SEQ ID NO: 201), containing a 3' tail with homology to the 5' end of PDC5 Fragment C. PDC5 Fragment C was amplified with primer oBP547 (SEQ ID NO: 202), containing a 5' tail with homology to the 3' end of PDC5 Fragment B-Fragment U, and primer oBP539 (SEQ ID NO: 203). PCR products were purified with a PCR purification kit (Qiagen, Valencia, Calif.). PDC5 Fragment B-Fragment U-Fragment C was created by overlapping PCR by mixing PDC5 Fragment B-Fragment U and PDC5 Fragment C and amplifying with primers T-B(kivD) (SEQ ID NO: 200) and oBP539 (SEQ ID NO: 203). The resulting PCR product was purified on an agarose gel followed by a gel extraction kit (Qiagen, Valencia, Calif.). The PDC5 A-kivD(y)-B-U-C cassette was created by overlapping PCR by mixing PDC5 Fragment A-kivD(y) Fragment and PDC5 Fragment B-Fragment U-PDC5 Fragment C and amplifying with primers T-A (PDC5) (SEQ ID NO: 194) and oBP539 (SEQ ID NO: 203). The PCR product was purified with a PCR purification kit (Qiagen, Valencia, Calif.).

Competent cells of PNY1714 were made and transformed with the PDC5 A-kivD(y)-B-U-C PCR cassette using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a pdc5 knockout kivD integration were screened for by PCR with primers oBP540 (SEQ ID NO: 204) and kivD(652R) (SEQ ID NO: 205) using genomic DNA prepared with a Gentra® Puregene® Yeast Bact. kit (Qiagen, Valencia, Calif.). The absence of the PDC5 gene from the isolate was demonstrated by a negative PCR result using primers specific for the coding sequence of PDC5, oBP552 (SEQ ID NO: 206) and oBP553 (SEQ ID NO: 207). To remove the URA3 marker from the chromosome, each correct transformant of both MATα and MATa strains was grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The deletion of PDC5, integration of kivD(y), and marker removal were confirmed by PCR with primers oBP540 and oBP541 using genomic DNA prepared with a Gentra® Puregene® Yeast/Bact. kit (Qiagen, Valencia, Calif.). The correct integration of the kivD(y) coding region was confirmed by DNA sequence with primers, kivD(652R) (SEQ ID NO: 205), kivD(602F) (SEQ ID NO: 208), and kivD(1250F) (SEQ ID NO: 209). The correct isolates were designated as strain PNY1716 (=MATa ura3Δ::loxP his3Δ::loxP pdc6Δ pdc Δ::ilvD pdc5Δ::kivD(y)).

FRA2 Deletion and UAS(PGK1)-FBA1p-ilvD(y)-TEF1t Integration

The FRA2 coding region was deleted and replaced with a cassette UAS(PGK1)-FAB1p-ilvD(y)-TEF1t-HisG-URA3-HisG by homologous recombination. The cassette UAS(PGK1)-FAB1p-ilvD(y)-TEF1t-HisG-URA3-HisG contains the hybrid promoter UAS(PGK1)-FAB1p, ilvD(v) coding region from *Streptococcus mutans* ATCC No. 700610, codon optimized for expression in *Saccharomyces cerevisiae*, TEF1t terminator, and URA3 gene along with the promoter and terminator, flanked by HisG fragments.

A plasmid pRS423-TPI1p-ilvD(y) (SEQ ID NO: 210) was digested with restriction enzymes NotI and SalI, and the 2,270 bp TPI1p-ilvD(y) fragment was purified on an agarose gel followed by a gel extraction kit (Qiagen, Valencia, Calif.). TPI1p-ilvD(y) fragment was cloned into NotI and SalI sites on pMOD-URA3r2 (SEQ ID NO: 211) to construct pMOD-URA3r2-TPI1p-ilvD(y). pMOD-URA3r2 is pUC19 based and contains the sequence of the URA3 gene flanked by HisG fragments. PCR TEF1t (285 bp) was amplified from *Saccharomyces cerevisiae* genomic DNA as template using Phusion® High Fidelity PCR Master Mix (New England BioLabs Inc.; Ipswich, Mass.) with primer T-TEF1t(NotI) (SEQ ID NO: 212) and primer B-TEF1t (NotI) (SEQ ID NO: 213). PCR TEF1t fragment was digested with a restriction enzyme NotI and then cloned into a NotI site on pMOD-URA3r2-TPI1p-ilvD(y). The correct orientation of TEF1t was confirmed by colony PCR analysis with T-DSmo(RPS5p) (SEQ ID NO: 214) and B-TEF1t (NotI) (SEQ ID NO: 213) with 2,009 bp of expected size. The resulting plasmid was designated as pMOD-URA3r2-TPI1p-ilvD(y)-TEF1t. Then, the TPI1p promoter on pMOD-URA3r2-TPI1p-ilvD(y)-TEF1t was replaced with the hybrid promoter UAS(PGK1)-FBA1p (SEQ ID NO: 215). PCR UAS(PGK1)-FBA1p cassette was amplified from a plasmid pRS316-UAS(PGK1)-FBA1p-GUS (SEQ ID NO: 216) using Phusion® High Fidelity PCR Master Mix (New England BioLabs Inc.; Ipswich, Mass.) with primer T-U/PGK1(XhoApa) (SEQ ID NO: 217) and primer B-FBA1 (SpeI) (SEQ ID NO: 218). PCR UAS(PGK1)-FBA1p product was digested with restriction enzymes XhoI and SpeI, and the PCR fragment was purified on an agarose gel followed by a gel extraction kit (Qiagen, Valencia, Calif.). pMOD-URA3r2-TPI1p-ilvD(y)-TEF1t was digested with restriction enzymes SalI and SpeI, and then 6,887 bp plasmid fragment lacking TPI1p was purified on an agarose gel followed by a gel extraction kit (Qiagen, Valencia, Calif.). The 6,887 bp pMOD-URA3r2- -ilvD(y)-TEF1t was ligated with UAS(PGK1)-FBA1p product digested with XhoI and SpeI to create pMOD-URA3r2-UAS(PGK1)-FBA1p-ilvD(y)-TEF1t (SEQ ID NO: 219). PCR cassette UAS(PGK1)-FAB1p-ilvD(y)-TEF1t-HisG-URA3-HisG was amplified from a plasmid pMOD-URA3r2-UAS(PGK1)-FBA1p-ilvD(y)-TEF1t using Phusion® High Fidelity PCR Master Mix (New England BioLabs Inc.; Ipswich, Mass.) with primers T-FRA(Dsm) (SEQ ID NO: 220), containing the 5' region 50 bp upstream of the FRA2 ATG, and B-FRA(Dsm) (SEQ ID NO: 221), containing the 3' region 50 bp downstream of the FRA2 coding region. The PCR product was purified with a PCR purification kit (Qiagen, Valencia, Calif.).

Competent cells of PNY1716 were made and transformed with the PCR cassette UAS(PGK1)-FAB1p-ilvD(y)-TEF1t-HisG-URA3-HisG using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a fra2 knockout UAS(PGK1)-FAB1p-ilvD(v)-TEF1t-HisG-URA3-HisG integration were screened for by PCR with primers oBP602 (SEQ ID NO: 222) and B-TEF1t(NotI) using genomic DNA prepared with a Gentra® Puregene® Yeast/Bact. kit (Qiagen, Valencia, Calif.). To remove the URA3 marker from the chromosome, correct transformants were grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The deletion of FRA2, integration of UAS (PGK1)-FAB1p-ilvD(y)-TEF1t, and URA3 marker removal were confirmed by DNA sequencing with primers DSm(o)50R (SEQ ID NO: 223), DSm(o)1F (SEQ ID NO: 224), DSm(o)688F (SEQ ID NO: 225), and DSm(o)1352F (SEQ ID NO: 226) using genomic DNA prepared with a Gentra® Puregene® Yeast/Bact. kit (Qiagen, Valencia, Calif.). The correct isolates were designated as strain PNY1720 (=MATa ura3Δ::loxP his3Δ::loxP pdc6Δ pdc1Δ::ilvD pdc5Δ::kivD(y) fra2Δ:: UAS(PGK1)-FBA1p-ilvD(y)).

GPD2 Deletion and FBA1p-alsS Integration

The GPD2 coding region was deleted and replaced with the FAB1 promoter and alsS coding region coding region by homologous recombination with a PCR cassette (URA3-FBA1p-alsS) containing the URA3p-URA3-URA3t cassette flanked by the degenerated loxP71/loxP66 sites, FBA1 promoter from *Saccharomyces cerevisiae*, and alsS from *Bacillus subtilis* subsp. *subtilis* str. 168 (GenBank No. NC_000964).

PCR URA3p-URA3-URA3t fragment flanked by loxP71/loxP66 sites was amplified from pLA59 (SEQ ID NO: 150) using Phusion® DNA polymerase (New England BioLabs Inc., Ipswich, Mass.) with primers T-URA(gpd_60 bp) (SEQ ID NO: 227), containing the 5' region 60 bp upstream of the GPD2 ATG, and B-URA(alsS) (SEQ ID NO: 228), containing a 3' tail with homology to the 5' end of the FBA1p-alsS fragment. PCR FBA1p-alsS fragment was amplified from pUC19-kan::pdc1::FBA-alsS::TRX1 (SEQ ID NO: 229) using Phusion® DNA polymerase (New England BioLabs Inc., Ipswich, Mass.) with primers T-alsS(URA) (SEQ ID NO: 230), containing a 5' tail with homology to the 3' end of the URA3p-URA3-URA3 fragment, and B-alsS(gpd_60 bp) (SEQ ID NO: 231), containing the 3' region 60 bp downstream of the GPD2 gene. The resulting PCR product was purified on an agarose gel followed by a gel extraction kit (Qiagen, Valencia, Calif.). The URA3-FBA1p-alsS cassette was created by overlapping PCR by mixing URA3p-URA3-URA3t fragment and FBA1p-alsS fragment and amplifying with primers T-URA(gpd_60 bp) and B-alsS (gpd_60 bp). The PCR product was purified with a PCR purification kit (Qiagen, Valencia, Calif.).

Competent cells of PNY1720 were made and transformed with the PCR cassette URA3-FBA1p-alsS using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a gpd2 knockout URA3-FBA1p-alsS integration were screened for by PCR with primers FBA-als1557 (SEQ ID NO: 232) and gpd2-down178 (SEQ ID NO: 233) using genomic DNA prepared with a Gentra® Puregene® Yeast/Bact. kit (Qiagen, Valencia, Calif.). The URA3 marker was recycled by transformation with pRS423::$P_{GAL1}$-cre (SEQ ID NO: 147) and plating on synthetic complete media lacking histidine supplemented with 0.5% ethanol at 30° C. Transformants were streaked on synthetic complete medium supplemented with 0.5% ethanol and containing 5-fluoro-orotic acid (0.1%) and incubated at 30° C. to select for isolates that lost the URA3 marker. 5-FOA resistant isolates were grown in YPE (0.5% ethanol) for removal of the pRS423::$P_{GAL1}$c-cre plasmid. The GPD2 deletion, FBA1p-alsS integration, and marker removal were checked by PCR with primers gpd2-up229 (SEQ ID NO: 234) and B-FBA1 (SpeI) (SEQ ID NO: 218), and confirmed by DNA sequencing with primers T-alsS(URA), FBA-als752 (SEQ ID NO: 235), FBA-als1557 (SEQ ID NO: 232), and gpd2-down 178 using genomic DNA prepared with a Gentra® Puregene® Yeast/Bact. kit (Qiagen, Valencia, Calif.). The correct isolates were designated as strains PNY1725 (=MATa ura3Δ::

loxP his3Δ::loxP pdc6Δ pdc1Δ::ilvD pdc5Δ::kivD(vi fra2Δ:: UAS(PGK1)-FBA1p-ilvD(y) gpd2Δ::loxP71/66-FBA1p-alsS).

BDH1 Deletion and UAS(PGK1)-ENO2p-ilvD-TEF1t-ILV5p-adh Integration

The BDH1 coding region was deleted and replaced with a cassette UAS(PGK1)-ENO2p-ilvD-TEF1t-ILV5p-adh by homologous recombination. The BDH1 deletion and UAS(PGK1)-ENO2p-ilvD-TEF1t-ILV5p-adh integration cassette (A-UAS(PGK1)-ENO2p-ilvD-TEF1t-ILV5p-adh-B-U-C) contains the homology upstream (fragment A) and downstream (fragment B) of the BDH1 coding region, hybrid promoter UAS(PGK1)-ENO2p, ilvD coding region from *Streptococcus mutans* ATCC No. 700610, TEF1t terminator, ILV5p promoter, adh coding region along with the terminator from *Beijerinckia indica*, and a URA3 gene along with the promoter and terminator (fragment U) for selection of transformants, and the 3' region of the BDH1 coding region (fragment C). The fragment A, UAS(PGK1)-ENO2p, ilvD, TEF1t, ILV5p, adh, fragment B, fragment U and fragment C were cloned into pUC19 based plasmid to create pBP1339 (=pA-UAS(PGK1)-ENO2p-ilvD-TEF1t-ILV5p-adh-B-U-C) (SEQ ID NO: 236). PCR cassette A-UAS(PGK1)-ENO2p-ilvD-TEF1t-ILV5p-adh-B-U-C was amplified from pBP1339 using Phusion® DNA polymerase (New England BioLabs Inc., Ipswich, Mass.) with primers oBP685 (SEQ ID NO: 237) and oBP690 (SEQ ID NO: 238). The PCR product was purified with a PCR purification kit (Qiagen, Valencia, Calif.).

Competent cells of PNY1725 were made and transformed with the PCR cassette A-UAS(PGK1)-ENO2p-ilvD-TEF1t-ILV5p-adh-B-U-C using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a bdh1 knockout UAS(PGK1)-ENO2p-ilvD-TEF1t-ILV5p-adh-B-U integration were screened for by PCR with primers oBP726 (SEQ ID NO: 239) and DSm1354F (SEQ ID NO: 240) using genomic DNA prepared with a Gentra® Puregene® Yeast/Bact. kit (Qiagen, Valencia, Calif.). To remove the URA3 marker from the chromosome, correct transformants were grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The deletion of BDH1, integration of UAS(PGK1)-ENO2p-ilvD-TEF1t-ILV5p-adh, and URA3 marker removal were confirmed by DNA sequencing with primers DSm788R (SEQ ID NO: 241), DSm696F (SEQ ID NO: 242), DSm1354F (SEQ ID NO: 240), ADHBi643R (SEQ ID NO: 243), and ADHBi554F (SEQ ID NO: 244) using genomic DNA prepared with a Gentra® Puregene® Yeast/Bact. kit (Qiagen, Valencia, Calif.). The correct isolates were designated as strains PNY1730 (=MATa ura3Δ::loxP his3Δ::loxP pdc6Δ pdc1Δ::ilvD pdc5Δ::kivD(y) fra2Δ:: UAS(PGK1)-FBA1p-ilvD(y)-gpd2Δ::loxP71/66-FBA1p-alsS bdh1Δ:: UAS(PGK1)-ENO2p-ilvD-ILV5p-adh).

YMR226c Deletion

The gene YMR226c was deleted in strain PNY1730 by homologous recombination using a PCR amplified 2.0 kb linear scarless deletion cassette. The cassette was constructed from spliced PCR amplified fragments comprised of the URA3 gene, along with its native promoter and terminator as a selectable marker, upstream and downstream homology sequences flanking the YMR226c gene chromosomal locus to promote integration of the deletion cassette and removal of the native intervening sequence and a repeat sequence to promote recombination and removal of the URA3 marker. The 1,208 bp URA3 expression cassette was PCR-amplified from pLA33 (SEQ ID NO: 160) with forward and reverse PCR primers N1251 (SEQ ID NO: 245) and N1252 (SEQ ID NO: 246). Forward and reverse primers N1253 (SEQ ID NO: 247) and N1254 (SEQ ID NO: 248) amplified a 250 bp downstream homology sequence with a 3' URA3 overlap sequence tag from a genomic DNA preparation of *Saccharomyces cerevisiae* strain PNY2211 (MATa ura3Δ::loxP his3Δ pdc6Δ pdc1Δ::P[PDC1]–DHAD|ilvD_Sm-PDCt-P[FBA1]-ALS|alsS_Bs-CYC1t pdc5Δ::P[PDC5]-ADH|sadB_Ax-PDC5t gpd2Δ::loxP fra2Δ adh1Δ:: UAS(PGK1)P[FBA1]-kivD_Ll(y)-ADH1t). Forward and reverse PCR primers N1256 (SEQ ID NO: 249) and N1255 (SEQ ID NO: 250) amplified a 250 bp repeat sequence with a 5' URA3 overlap sequence tag from a genomic DNA preparation of *Saccharomyces cerevisiae* strain PNY2211. Forward and reverse PCR primers N1257 (SEQ ID NO: 251) and N1258 (SEQ ID NO: 252) amplified a 250 bp upstream homology sequence with a 5' repeat overlap sequence tag from a genomic DNA preparation of *Saccharomyces cerevisiae* strain PNY2211.

Approximately 1.5 µg of the PCR amplified cassette was transformed into strain PNY1730 made competent using the Frozen-EZ Yeast Transformation II™ kit (Zymo Research Corporation, Irvine, Calif.) and the transformation mix plated on the synthetic complete media lacking uracil supplemented with 0.5% ethanol (no glucose) at 30° C. for selection of cells with an integrated ymr226cΔ:: URA3 cassette. Transformants appearing after 72 to 96 hours are subsequently short-streaked on the same medium and incubated at 30° C. for 24 to 48 hours. The short-streaks are screened for ymr226cΔ::LURA3 by PCR, with a 5' outward facing URA3 deletion cassette-specific internal primer N1249 (SEQ ID NO: 253) paired with a flanking inward facing chromosome-specific primer N1239 (SEQ ID NO: 254) and a 3' outward-facing URA3 deletion cassette-specific primer N1250 (SEQ ID NO: 255) paired with a flanking inward-facing chromosome-specific primer N1242 (SEQ ID NO: 256). A positive PNY1730 ymr226cΔ::URA3 PCR screen resulted in 5' and 3' PCR products of 598 and 726 bp, respectively.

The positive PNY1730 ymr226cΔ:: URA3 clones were cultured overnight in a YPE (0.5% ethanol) and then was plated on synthetic complete medium supplemented with ethanol (no glucose) and containing 5-fluoro-orotic acid (0.1%) at 30° C. to select for isolates that lost the URA3 marker. Colonies appearing after 24 to 48 hours were PCR screened for marker loss with 5' and 3' chromosome-specific primers N1239 and N1242. A positive PNY1730 ymr226cΔ markerless PCR screen resulted in a PCR product of 801 bp. The strain PNY1730 ymr226cΔ was designated PNY1758 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS-bdh1Δ::UAS(PGK1)-ENO2p-ilvD-ILV5p-adh ymr226cΔ).

Construction of isobutanologen PNY1775

PNY1758 were transformed with two plasmids pWZ009 (SEQ ID NO: 158) carrying K9D3.KARI gene from *Anaerostipes caccae* DSM 14662 and pWZ001 (SEQ ID NO: 159) carrying ilvD gene from *Streptococcus mutans* ATCC No. 700610. Competent cells of PNY1775 were made and co-transformed with plasmids pWZ009 and pWZ001 using a Frozen-EZ Yeast Transformation II™ kit (Zymo Research Corporation, Irvine, Calif.). Transformed cells were plated on synthetic complete media lacking uracil and histidine supplemented with 0.5% ethanol (no glucose) at 30° C. Resulting transformant was designated the isobutanologen strain PNY1775 (=MATa ura3Δ::loxP his3Δ::loxP pdc6Δ pdc1Δ::ilvD pdc5Δ::kivD(y) fra2Δ::UAS(PGK1)-FBA1p-ilvD(y)-gpd2Δ::loxP71/66-FBA1p-alsS bdh1Δ:: UAS(PGK1)-ENO2p-ilvD-ILV5p-adh ymr226cΔ/pWZ009, pWZ001).

Construction of Isobutanologen PNY1789

The strains PNY1730 (=MATa ura3Δ::loxP his3Δ::loxP pdc6Δ pdc1Δ::ilvD pdc5Δ::kivD(y)fra2Δ:: UAS(PGK1)-FBA1p-ilvD(y)-gpd2::loxP71/66-FBA1p-alsS bdh1Δ:: UAS(PGK1)-ENO2p-ilvD-ILV5p-adh) was used to generate the isobutanologen PNY1789.

Replacement of pdc5Δ::kivD(y) with pdc5Δ::kivD.Lg.y

The *Lactococuss lactis* kivD(y) coding region integrated at the pdc5Δ deletion region in PNY1730 was replaced with *Listeria gravi* kivD gene that was codon-optimized for *Saccharomyces cerevisiae* (=kivD.Lg.y) by homologous recombination.

The kivD.Lg.y integration cassette (A-KivD.Lg.y-B-U-C) contains the homology upstream (fragment A) and downstream (fragment B) of the PDC5 coding region, kivD.Lg.y coding region from *Listeria grayi*, URA3 gene along with the promoter and terminator (fragment U) for selection of transformants, and the 3' region of the kivD.Li.y coding region (fragment C). The fragment A was amplified from PNY0891 genomic DNA as template with primer T-A (PDC5) (SEQ ID NO: 194). and B-A(kivDLg) (SEQ ID NO: 257), containing a 5' tail with homology to the 5' end of kivD.Li.y. The kivD.Li.v coding region was amplified from pBP1719 (=pUC19-ura3MCS-U(PGK1)Pfbai-kivD Lg(y)-ADH1 BAC-kivD.LI fragment C (SEQ ID NO: 258) with primer T-kivDLg(A) (SEQ ID NO: 259), containing a 5' tail with homology to the 3' end of the fragment A, and B-kivDLg(B) (SEQ ID NO: 260), containing a 5' tail with homology to the 5' end of the fragment B. The fragment B-U was amplified from pBP904 (=pUC19-URA3-sadB-PDC5fragmentB) (SEQ ID NO: 261) with primer T-B (kivDLg) (SEQ ID NO: 262), containing a 5' tail with homology to the 3' end of kivD.Li.y, and oBP546(new) (SEQ ID NO: 263), containing a 5' tail with homology to the 5' end of the fragment C. The fragment C was amplified with primer oBP547(new) (SEQ ID NO: 264), containing a 5' tail with homology to the 3' end of the fragment U, and primer oBP539(new) (SEQ ID NO: 265). PCR products were purified with a PCR purification kit (Qiagen, Valencia, Calif.). The fragment A-KivD.Lg.y was created by overlapping PCR by mixing the fragment A and fragment KivD.Lg.y and amplifying with primers T-A(PDC5) and B-kivDLg(B). The fragment B-U-C was created by overlapping PCR by mixing the fragment B-U and fragment C and amplifying with primers T-B(kivDLg) and oBP539 (new). The resulting PCR products were gel-purified on an agarose gel followed by a gel extraction kit (Qiagen, Valencia, Calif.). The A-KivD.Lg.y-B-U-C cassette was created by overlapping PCR by mixing the fragment A-KivD.Lg.y and fragment B-U-C and amplifying with primers T-A (PDC5) and oBP539(new). The PCR product was purified with a PCR purification kit (Qiagen, Valencia, Calif.).

Competent cells of PNY1730 were made and transformed with the PCR cassette A-KivD.Lg.y-B-U-C using a Frozen-EZ Yeast Transformation II™ kit (Zymo Research Corporation, Irvine, Calif.). Transformation mixtures were plated on synthetic complete media lacking uracil supplemented with 0.5% ethanol (no glucose) at 30° C. Transformants with a A-KivD.Lg.y-B-U-C integration were screened for by PCR with primer sets oBP540/kivDLg(569R) and kivDLg (530F)/oBP541 using genomic DNA prepared with a Gentra® Puregene® Yeast/Bact. kit (Qiagen, Valencia, Calif.). To remove the URA3 marker from the chromosome, correct transformants were grown overnight in YPE (0.5% ethanol) and plated on synthetic complete medium supplemented with ethanol (no glucose) and containing 5-fluoro-orotic acid (0.1%) at 30° C. to select for isolates that lost the URA3 marker. The replacement of kivD(y) with kivD.Lg.y, and URA3 marker removal were confirmed by DNA sequencing with primers kivDLg(569R) (SEQ ID NO: 266), kivDLg (530F) (SEQ ID NO: 267), and kivDLg(1162F) (SEQ ID NO: 268) using genomic DNA prepared with a Gentra® Puregene® Yeast/Bact. kit (Qiagen, Valencia, Calif.). The correct isolates were designated as PNY1787 (=MATa ura3Δ::loxP his3Δ::loxP pdc6Δ pdc1Δ:: ilvD pdc5Δ:: kivD.Lg.y fra2Δ:: UAS(PGK1)-FBA1p-ilvD.y gpd2Δ:: loxP71/66-FBA1p-alsS bdh1Δ:: UAS(PGK1)-ENO2p-ilvD-ILV5p-adh).

HIS3+Restoration

The deleted HIS3 coding sequence was restored in strain PNY1787 by homologous recombination with a PCR cassette containing the HIS3 coding region and upstream and downstream homologies.

The HIS3 coding PCR cassette containing the HIS3 coding region and upstream and downstream flanking regions was amplified from PNY891 genomic DNA as template with primer T-HIS3(up300) (SEQ ID NO: 269) and primer B-HIS3(down273) (SEQ ID NO: 270). The resulting PCR products were gel-purified on an agarose gel followed by a gel extraction kit (Qiagen, Valencia, Calif.). Competent cells of PNY1773 were made and transformed with the HIS3+ PCR cassette using a Frozen-EZ Yeast Transformation II™ kit (Zymo Research Corporation, Irvine, Calif.). Transformation mixtures were plated on synthetic complete media lacking histidine supplemented with 0.5% ethanol (no glucose) at 30° C. Transformants with a HIS3+ integration were screened for growth on synthetic complete media lacking histidine supplemented with 0.5% ethanol (no glucose), and confirmed by colony PCR with primer sets T-HIS3(up300) and primer B-HIS3(down273). The correct isolates were designated as PNY1788 (=MATa ura3Δ::loxP pdc6Δ pdc1Δ::ilvD pdc5Δ::kivD.Lg.y fra2Δ:: UAS(PGK1)-FBA1p-ilvD.y gpd2Δ::loxP71/66-FBA41p-alsS bdh1Δ:: UAS(PGK1)-ENO2p-ilvD-ILV5p-adh).

PNY1788 were transformed with a plasmid pNZ001 (SEQ ID NO: 271) carrying K9D3.KARI gene from *Anaerostipes caccae* DSM 14662 and ilvD gene from *Streptococcus mutans* ATCC No. 700610. Competent cells of PNY1788 were made and co-transformed with a plasmid pNZ001 using a Frozen-EZ Yeast Transformation II™ kit (Zymo Research Corporation, Irvine, Calif.). Transformed cells were plated on synthetic complete media lacking uracil supplemented with 0.5% ethanol (no glucose) at 30° C. Resulting transformant was designated the isobutanologen strain PNY1789 (=MATa ura3Δ::loxP pdc6Δ pdc1Δ::ilvD pdc5::kivD(y)fra2Δ::UAS(PGK1)-FBA1p-ilvD(y)-gpd2Δ:: loxP71/66-FBA1p-alsS bdh1Δ:: UAS(PGK1)-ENO2p-ilvD-ILV5p-adh/pNZ001).

Example 3

Construction of Isobutanologens with a PDE1 Deletion

To delete the endogenous PDE1 coding region in PNY01758, a deletion cassette was PCR-amplified from pLA59 (SEQ ID NO: 150) which contains URA3p-URA3-

URA3t cassette flanked by degenerate loxP71 and loxP66 sites for removal of the URA3 marker. PCR was performed using Phusion® DNA polymerase (New England BioLabs Inc., Ipswich, Mass.) and primers PDE1 F URA3 (SEQ ID NO: 151) and PDE1 R URA3 (SEQ ID NO: 152). The PCR product was transformed into PNY01758 using standard genetic techniques (Methods in Yeast Genetics, 2005, Cold Spring Harbor Laboratory Press, Cold Spring Harbor, N.Y., pp. 201-202) with selection on synthetic complete media (1× yeast nitrogen base without amino acids, 1× amino acid mix lacking uracil) supplemented with 5 g/L ethanol at 30° C. Transformants were screened by colony PCR with primers URA1R and PDE1F (SEQ ID NOs: 153 and 154) to verify the presence of the integration cassette, and URA1F and PDE1R (SEQ ID NOs: 155 and 156). To remove URA3 marker of the cassette, cells were transformed with pRS423::GAL1p-cre (SEQ ID NO: 147) and transformants were selected on synthetic complete media (1× yeast nitrogen base without amino acids, 1× amino acid mix lacking histidine) supplemented with 5 g/L ethanol at 30° C. Transformants were plated on yeast extract+peptone (YP) agar plate supplemented with 0.5% galactose to induce expression of Cre-recombinase. Marker removal was confirmed by patching colonies to synthetic complete media lacking uracil and supplemented with 5 g/L ethanol to verify absence of growth. Deletion and marker removal also confirmed by PCR and sequencing with primers PDE1F and PDE1R (SEQ ID NOs: 154 and 156) using genomic DNA prepared with Gentra® Puregene® Yeast/Bact. kit (Qiagen, Valencia, Calif.). The resulting PDE1 deletion strain of PNY01758 named PNY03040 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS bdh1 Δ::UAS(PGK1)-ENO2p-ilvD-ILV5p-adh ymr226cΔ PDE1A::loxP71/66).

Construction of Isobutanologens PNY01759 and PNY03041

PNY01758 and PNY03040 were transformed with plasmid pK9D3.OLE1p.IlvD (SEQ ID NO: 157) carrying K9D3.KARI gene from *Anaerostipes caccae* DSM 14662 and carrying ilvD gene from *Streptococcus mutans* ATCC No. 700610. Competent cells of PNY01758 and PNY03040 were made and transformed with plasmids pK9D3.OLE1p.IlvD (SEQ ID NO: 157) using a Frozen-EZ Yeast Transformation II™ kit (Zymo Research Corporation, Irvine, Calif.). Transformed cells were plated on synthetic complete media lacking uracil supplemented with 0.5% ethanol (no glucose) at 30° C. Resulting transformant was designated the isobutanologen strain PNY01759 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS bdh1 Δ::UAS(PGK1)-ENO2p-ilvD-ILV5p-adh ymr226cΔ/pK9D3.OLE1p.IlvD) and PNY03041 (=MATa ura3Δ::loxP his3Δ::loxP pdc6Δ pdc1Δ::ilvD pdc5Δ::kivD(y) fra2Δ::UAS(PGK1)-FBA1p-ilvD(y) gpd2Δ::loxP71/66-FBA1p-alsS bdh1Δ::UAS(PGK1)-ENO2p-ilvD-ILV5p-adh ymr226cΔPDE1Δ::loxP71/66/pK9D3.OLE 1p.IlvD).

Isobutanologens PNY01759 and PNY03041 were grown in synthetic medium (1× yeast nitrogen base without amino acids and yeast synthetic drop-out media supplement without uracil) supplemented with 2 g/L sucrose and 5 g/L ethanol in a 125 mL vented flask. Cells were grown at 30° C. with shaking at 250 rpm overnight. Two independent colonies of PNY03041, namely 3041#5 and 3041#18 were purified on synthetic complete media lacking uracil supplemented with 5 g/L ethanol (no glucose) and 2 g/L sucrose at 30° C. and used in subsequent experiments.

Example 4

Effect of PDE1 Deletion on Sucrose Hydrolysis

Cells were grown on YPD plates (10 g/L peptone, 5 g/L yeast extract, and 20 g/L glucose) at 30° C. for 24 h. One loop-full of PNY01500 cells or PNY03001 (PDE1Δ) cells (from plates) was inoculated in 20 mL synthetic complete medium (SC) (1× yeast nitrogen base without amino acids, 1× amino acid mix supplemented with uracil and histidine) containing 20 g/L glucose and incubated at 30° C. for 24 h. Cells were centrifuged and resuspended in SC medium containing 43-44 g/L sucrose. Optical density of the cells were adjusted to 10 (OD$_{600}$) and the tubes were incubated at 30° C. at 220 rpm. Samples (10 mL volume) were added to 50 mL screw cap tube. Approximately 0.5 mL of sample was withdrawn from each tube after 2, 6, and 8 hours of inoculation, centrifuged, and filter sterilized before analysis of residual sugar content. Residual sucrose and glucose content of the media were estimated using YSI 2300 STAT Plus™ Glucose & Lactate Analyzer (YSI Life Sciences, Yellow Springs, Ohio).

Residual sugar content of PNY01500 and PNY03001 (PDE1Δ) grown in synthetic complete media containing sucrose as carbon source are shown in Table 6. PNY01500 cells and PNY03001 cells showed similar patterns of sucrose hydrolysis and sugar consumption in SC medium. Deletion of PDE1 did not negatively influence sucrose hydrolysis and sugar consumption.

TABLE 6

| Strains | URA3 and HIS5 KO | Residual sucrose content (g/L) | | | | Residual glucose content (g/L) | | | |
|---|---|---|---|---|---|---|---|---|---|
| | | 0 h | 2 h | 6 h | 8 h | 0 h | 2 h | 6 h | 8 h |
| PNY01500 | none | 42.95 | 15.7 | 2.65 | 0.42 | 1.8 | 15.1 | 9.65 | 2.2 |
| PNY03001 | PDE1 | 43.7 | 16.2 | 3.3 | 0.51 | 1.65 | 16.5 | 9.45 | 2.6 |

Example 5

Sucrose Hydrolysis in the Presence of Isobutanol

One loop-full of PNY01500 cells or PNY03001 (PDE1Δ) cells from plates was inoculated in 20 mL SC media (1× yeast nitrogen base without amino acids, 1× amino acid mix supplemented with uracil and histidine) containing 20 g/L glucose and incubated at 30° C. for 24 h. Cells were centrifuged and resuspended in SC medium containing 43-44 g/L sucrose and 15 g/L isobutanol. Optical density of the cells was adjusted to 10 (OD$_{600}$) and the tubes were incubated at 30° C. at 220 rpm for 16 h. Samples (10 mL volume) were added to 50 mL screw cap tube. Approximately 0.5 mL of sample was collected from each tube at 0 hour and after 3 and 5 hours of inoculation. The samples were centrifuged and filter sterilized before analysis of the residual sugar content. Residual sucrose, glucose, fructose, and ethanol content were estimated by HPLC (1260 Infinity System, Agilent Life Sciences, Santa Clara, Calif.) using an HPX 87N Aminex® column, 300×7.8 mm (BioRad Laboratories, Hercules, Calif.).

Residual sugar content of PNY01500 and PNY03001 (PDE1Δ) grown in synthetic complete media containing sucrose and isobutanol are shown in Table 7. The sucrose hydrolysis rate of PNY01500 and PNY03001 in synthetic complete medium containing 15 g/L isobutanol was compared. PNY01500 cells and PNY03001 cells showed a different pattern of sucrose hydrolysis and sugar consumption in SC medium containing 15 g/L isobutanol. PNY03001 cells hydrolyzed sucrose at faster rate than PNY01500. After 5 hr incubation, PNY03001 also consumed hydrolyzed sugars and produced 50% more ethanol compared to PNY01500. Deletion of PDE1 positively influenced sucrose hydrolysis and sugar metabolism in the presence of isobutanol. The PDE1 deletion appears to have improved fermentation performance.

TABLE 7

| Strains | Knock out | Residual sugar in different time intervals (g/L) | | | | | | | | | EtOH produced in different time intervals | | |
|---|---|---|---|---|---|---|---|---|---|---|---|---|---|
| | | Sucrose | | | Glucose | | | Fructose | | | | | |
| | | 0 h | 3 h | 5 h | 0 h | 3 h | 5 h | 0 h | 3 h | 5 h | 0 h | 3 h | 5 h |
| PNY01500 | none | 41.5 | 29.1 | 25.7 | 7.2 | 10.2 | 12.5 | 7.5 | 11.9 | 15.3 | 0 | 0 | 1.7 |
| PNY03001 | PDE1 | 40.5 | 16.9 | 10.6 | 9.6 | 13.1 | 18.1 | 9.2 | 15.8 | 22 | 0 | 1.2 | 3.4 |

Example 6

Sucrose Hydrolysis and Isobutanol Titer in PDE1 Knock-Out Strain

PNY01759 and PNY03041 cells (3041#5 and 3041#18) were grown as described in Example 5 and cells were precipitated by centrifugation at 3000 rpm for 5 minutes at 25° C. and supernatant was discarded.

Production Phase

Cells were diluted to 10 ($OD_{600}$), about 7-8 g/L dry cell weight, using production medium (PM) (Tables 8 and 9) in 50 mL screw cap tube. The medium was filter sterilized using 0.22 μm filter paper before use. Tubes were agitated at 200 rpm at 30° C. for 20 h and centrifuged at 4000 rpm for 5 minutes. Samples was preserved for analysis by HPLC of residual sucrose and isobutanol produced. The cell pellet was then subjected to an acid wash.

TABLE 8

Production medium (PM)

| Ingredients | UOM | 1 L Medium |
|---|---|---|
| $K_2HPO_4$ | gm | 6.0 |
| $CaCl_2 \cdot 2H_2O$ | gm | 0.076 |
| $MgSO_4 \cdot 7H_2O$ | gm | 1.0 |
| $MnCl_2 \cdot 4H_2O$ | gm | 0.10 |
| $ZnSO_4 \cdot 7H_2O$ | gm | 0.029 |
| $FeCl_3$ | gm | 0.006 |
| $Na_2SO_4$ | gm | 0.16 |
| YNB w/o amino acid | gm | 13.4 |
| Yeast Extract | gm | 6.0 |
| Sucrose | gm | 25.0 |
| Ethanol | mL | 6.25 |
| Delft Vitamin solution | mL | 1.0 |
| MES* | gm | 19.5 |
| Ampicillin (5%) | mL | 1.0 |
| Chloramphenicol (34 mg/mL) | mL | 0.5 |
| Water (vol make up) | mL | 1000 |

Adjust pH to 5.50 ± 0.1 with dilute sulfuric acid
Filter sterilize and store at RT
*MES: (2-(N-morpholino)ethanesulfonic acid

TABLE 9

Vitamin Solution 1000X

| Chemical/Product | UOM | 1 L Medium |
|---|---|---|
| Biotin (D−) | gm | 0.05 |
| Ca D(+) panthotenate | gm | 1.0 |
| Nicotinic acid | gm | 15.0 |
| Myo-inositol (for microbiology) | gm | 25.0 |
| Thiamine chloride hydrochloride | gm | 20.0 |
| Pyridoxol hydrochloride | gm | 1.0 |
| p-Aminobenzoic acid | gm | 0.4 |
| Riboflavin | gm | 0.75 |
| Folic acid | gm | 0.004 |
| Water (vol make up) | ml | 1000 |

Acid Wash Phase

The cell pellet was resuspended in 10 mL acid wash medium (AWM), pH 2 (Table 10) and agitated at 200 rpm at 30° C. for 120 minutes.

TABLE 10

Acid Wash medium (AWM)

| Ingredients | UOM | 1 L Medium |
|---|---|---|
| $K_2HPO_4$ | gm | 6.0 |
| $CaCl_2 \cdot 2H_2O$ | gm | 0.076 |

TABLE 10-continued

| Acid Wash medium (AWM) | | |
|---|---|---|
| Ingredients | UOM | 1 L Medium |
| MgSO$_4$•7H$_2$0 | gm | 1.0 |
| MnCl$_2$•4H$_2$O | gm | 0.10 |
| ZnSO$_4$•H$_2$0 | gm | 0.029 |
| FeCl$_3$ | gm | 0.006 |
| Na$_2$SO$_4$ | gm | 0.16 |
| YNB w/o amino acid | gm | 13.4 |
| Yeast Extract | gm | 6.0 |
| Ampicillin (5%) | mL | 1.0 |
| Chloramphenicol (34 mg/mL) | mL | 0.5 |
| Water (vol make up) | mL | 1000 |

Adjust pH to 2.20 ± 0.1 with 1M Sulfuric acid
Filter sterilize before adding acid to lower pH and store at RT Cell Recycling After the acid wash phase, cells were collected by centrifugation at 3000 rpm for 4 minutes; the supernatant discarded, and 10 mL fresh PM was added to the cells. Cells were incubated and samples were collected for HPLC to determine residual sucrose content. After each production phase, cells were subjected to an acid wash and then the cells were recycled.

Quantification of residual sucrose in the culture after 20 h incubation in PM indicated that sucrose degradation gradually decreased in PNY01759 after acid wash of the cells (Table 11). PNY03041 (PDE1Δ) hydrolyzed sucrose efficiently, and there was no sucrose accumulation after three rounds of acid wash of the cells. Residual sucrose content of the culture increased after the second and third round of acid wash. PNY0341 cells produced more isobutanol after acid wash of the cells compared to PNY01759 (Table 12). These results indicate that PDE1 deletion improves sucrose hydrolysis and improves isobutanol titer of isobutanologens.

TABLE 11

| Isobutanologens | PNY01759 | 3041#5 | 3041#18 |
|---|---|---|---|
| Residual sucrose content before acid wash (g/L) | 0 | 0 | 0 |
| Residual sucrose content after 1$^{st}$ acid wash (g/L) | 0.14 (±0.1) | 0 | 0 |
| Residual sucrose content after 2$^{nd}$ acid wash (g/L) | 4.0 (±1.2) | 0.25 (±0.15) | 0.15 (±0.1) |
| Residual sucrose content after 3$^{rd}$ acid wash (g/L) | 9.0 (±1.5) | 1.0 (±0.4) | 0.9 (±0.5) |

TABLE 12

| | | Isobutanol titer of cells (g/L) | | |
|---|---|---|---|---|
| Isobutanologens | Strains | Before acid wash | After 1$^{st}$ acid wash | After 2$^{nd}$ acid wash |
| PNY1759 | 1759a | 8.32 | 5.72 | 0.31 |
| | 1759b | 7.55 | 5.57 | 0.34 |
| PNY03041 | 3041 #5 | 8.12 | 8.64 | 1.3 |
| | 3041 #18 | 7.83 | 8.47 | 0.97 |

Example 7

Cell Viability of PDE1 Knock-out after Acid Wash

Isobutanologens strain PNY01759 and PNY03041 (PDE1Δ) were grown in SC medium (1× yeast nitrogen base without amino acids and yeast synthetic drop-out media without uracil) supplemented with 2 g/L sucrose and 5 g/L ethanol in a 125 mL vented flask. Cells were grown at 30° C. with shaking at 250 rpm overnight. The cells were precipitated by centrifugation at 3000 rpm for 5 minutes at 25° C., the supernatant was discarded, and cells were resuspended in CPM at initial OD$_{600}$ 20. The cells were subjected to stringent acid wash phase and production phase as described in Example 6. Samples were removed once at the end of the acid wash phase for viable cell count (CFU/mL) assay. For this purpose, 0.1 mL of culture was diluted in 1× yeast nitrogen base to 10$^{-7}$ and 0.005 mL of the diluted culture was spotted on agar plates of synthetic complete medium lacking uracil and supplemented with 5 g/L ethanol as carbon source. Colony Forming Unit (CFU) per 1 mL of culture was calculated after enumeration of colonies after 48-72 h incubation of plates at 30° C.

The viable cell count of PNY01759 was reduced to 4×10$^2$ after three acid wash, whereas the viable cell count of PNY03041 after three acid wash was 6.5×10$^4$ (Table 13). PDE1 gene knock-out in an isobutanologen improved cell viability after acid wash of the cells.

TABLE 13

| Isobutanologens | PNY01759 | PNY01759 | PNY03041 | PNY03041 |
|---|---|---|---|---|
| Viable cell count before acid wash (CFU/mL) | 1.6 × 10$^7$ | 2.0 × 10$^7$ | 2.4 × 10$^7$ | 3.1 × 10$^7$ |
| Viable cell count after 1$^{st}$ acid wash (CFU/mL) | 1 × 10$^6$ | 0.8 × 10$^6$ | 7 × 10$^6$ | 8 × 10$^6$ |
| Viable cell count after 2$^{nd}$ acid wash (CFU/mL) | 0.9 × 10$^3$ | 2 × 10$^3$ | 1 × 10$^5$ | 2 × 10$^5$ |
| Viable cell count after 3$^{rd}$ acid wash (CFU/mL) | 3 × 10$^2$ | 5 × 10$^2$ | 7 × 10$^4$ | 6 × 10$^4$ |

Example 8

Growth Rate of PDE1 Knock-out in Synthetic Medium

PNY03041 (PDE1Δ) and PNY01759 cells were inoculated in synthetic complete medium (1× yeast nitrogen base without amino acids and yeast synthetic drop-out media without uracil) supplemented with 2 g/L sucrose and 5 g/L ethanol in a 125 mL vented flask at an initial OD$_{600}$ of 0.5. Flasks were incubated at 30° C. with agitation at 220 rpm for 24 h. Samples were collected in 2 h intervals and the growth rate was calculated based on optical density. The growth rate (μ) of PDE1 knock-out PNY03041 was greater as compared to PNY01759. The growth rate of PNY03041 was 0.2 and the growth rate of PNY01759 was 0.12. In rich media YPE (10 g/L yeast extract, 5 g/L peptone, and 5 g/L ethanol), PNY03041 and PNY01759 had similar growth rates (0.27-0.28).

Example 9

Isobutanol Tolerance of PDE1 Knock-out

PNY03041 (PDE1Δ) and PNY01759 cells were inoculated in synthetic complete medium (1× yeast nitrogen base without amino acids and yeast synthetic drop-out media without uracil) supplemented with 2 g/L sucrose and 5 g/L ethanol in a 125 mL vented flask at an initial $OD_{600}$ of 0.5. Flasks were incubated at 30° C. with agitation at 220 rpm for 24 h. Cells were recovered by centrifugation and suspended to 20 ($OD_{600}$) with the same medium supplemented with 30 g/L isobutanol. Cells were incubated for 11 h with agitation at 200 rpm. Viable cell count was performed in synthetic complete medium with ethanol as carbon source at time 0 and at 11 h. For this purpose, the culture was diluted in 1× yeast nitrogen base medium to $10^{-7}$ and 0.005 mL of diluted cell suspension was spotted on agar plates. Plates were incubated at 30° C. for 48-72 h and CFU/mL was calculated after enumeration of colonies on the plates.

Results are shown in Table 14. Cell death was reduced in PNY03041 compared to PNY01759 in medium containing 30 g/L isobutanol. It may be concluded that PDE

TABLE 14

| Strains | Viable cell count (CFU/ml) | |
|---|---|---|
| | 0 h | 11 h |
| PNY01759 | $1.7 \times 10^7$ | $9 \times 10^4$ |
| PNY03041 | $1.2 \times 10^7$ | $2 \times 10^6$ |

Example 10

Cell Recycling

Cells of PNY01775 were streaked from glycerol stock onto synthetic complete medium plates (1× yeast nitrogen base without amino acids, 1× amino acid drop-out without histidine and uracil, 1% w/v agar) containing 5 g/L ethanol as carbon source. After 48 h incubation at 30° C., a patch of cells from the plate was inoculated in 20 mL synthetic complete liquid medium in 125 mL flask containing 2 g/L sucrose and 5 g/L ethanol as carbon source. Cells were grown at 30° C. for 24 h with agitation at 200 rpm in shakers (Innova 44R, New Brunswick Scientific, CT, USA). This culture was used to inoculate 500 mL growth medium CIG#2 (Table 15).

TABLE 15

CIG #2 medium
Isobutanologen Growth Medium #2
Isobutanologen Growth Medium, pH 6.0, 2 g/L sucrose
(0.2%), 5 g/L ethanol (0.5%), 5 g/L Yeast Extract

| Component | Final Concentration | | 1 L Medium |
|---|---|---|---|
| Yeast Nitrogen Base without amino acids | 0.67% | | 6.7 g |
| Delft Vitamin Solution | | | 1 mL |
| MES Buffer, pH 6.0 | 100 mM | MES Stock = 1M | 100 mL |
| Yeast Extract | 5 g/L | Solid added | 5 g |
| Sucrose | 2 g/L | | 2 g |
| Ethanol | 5 g/L | Ethanol Stock = 79% | 6.3 mL |

The culture was grown in 100 mL medium in 500 mL flasks with an initial $OD_{600}$ of 0.3-0.5 and incubated at 30° C. at 200 rpm. After 24 h, cells were harvested by centrifugation at 4000 rpm for 5 minutes and resuspended with an initial $OD_{600}$ of 10 in recycle and production medium, CRP#2 medium (Table 16).

TABLE 16

CRP #2 medium
Recycle and Production Medium #2
Recycle and Production Medium, pH 6.0, 25 g/L sucrose,
2 g/L ethanol, 20 mg/L thiamine, 100 mg/L nicotinamide

| Component | Final Concentration | | 1 L Medium |
|---|---|---|---|
| Ammonium phosphate, dibasic | 0.008 mg/L | | |
| Magnesium sulfate | 0.2 g/L | Stock = 40 g/L | |
| Manganese sulfate | 0.1 g/L | Stock = 40 g/L | |
| Zinc Sulfate | 0.025 g/L | Stock = 5 g/L | |
| Delft Trace Mineral Solution | 1 mL | | 1 mL |
| Delft Vitamin Solution | 1 mL | | 1 mL |
| MES Buffer, pH 6.0 | 100 mM | MES Stock = 1M | 100 mL |
| Casamino acids | 0.6 g/L | | |
| Sucrose | 25 g/L | | 25 g |
| Ethanol | 0.20% | Ethanol Stock = 79% | 2.6 mL |
| Thiamine | 20 mg/L | Stock = 2 g/L | 10 mL |
| Nicotinamide | 100 mg/L | Stock = 30 g/L | 10 mL |

The production phase was carried out in 50 mL screw cap tubes containing 10 mL production medium and 5 mL autoclaved extractant Isofol®16 (Sasol Olefins & Surfactants GmbH, Germany) or extractant mixture Isofol®16+ Trioctyl Phosphine Oxide (TOPO) (Sigma-Aldrich Co, St. Louis, Mo., USA). The extractant mixture (Isofol®16+ TOPO) was prepared by slowly dissolving 50 g TOPO in 40 mL autoclaved Isofol®16. Samples for 0 h time point (t=0 h) were collected immediately after adding the production medium and extractant. To avoid the loss of cells during 0 h sampling, tubes were spun at 4000 rpm for 2 minutes prior to sample collection. One milliliter of sample was collected from each phase (aqueous as well as organic extractant phase). The tubes were tilted at an angle of 45° in a tube holder and incubated at 30° C. with agitation at 160 rpm. After 7 h incubation, samples were centrifuged at 4000 rpm for 2 minutes and 1 mL samples were collected from each phase. All samples were stored at −80° C. until further analysis for sugars and metabolites by HPLC (1260 Infinity System, Agilent Life Sciences, Santa Clara, Calif.) using an HPX 87N Aminex® column, 300×7.8 mm (BioRad Laboratories, Hercules, Calif.) and gas chromatography (7890A GC System, Agilent Life Sciences, Santa Clara, Calif.) using HP-INNOWAX column (30 m×0.32 mm and film 0.25 μm, Agilent Life Sciences, Santa Clara, Calif.). A seven hour incubation in production medium (CRP#2) was considered as the production phase. After each production phase, cells were collected by centrifugation and subjected to acid wash.

For acid wash, cells were harvested by centrifugation at 4000 rpm, resuspended in 1 mL acid wash medium (CRP#2 medium with pH adjusted to 2 using sulfuric acid), and mixed by vortexing. Tubes were tilted at an angle of 45' to prevent settling of cells at the bottom and incubated at 30° C. at 200 rpm for 1 h. This phase was considered as the acid wash phase. Acid washed cells were re-used (cell recycling, R) for isobutanol production.

For cell recycling, the cells were harvested by centrifugation at 4000 rpm after each acid wash phase and resuspended in 10 mL fresh production medium (CRP#2) and 5 mL autoclaved extractant.

PNY1775 was recycled in presence of extractant, Isofol®16 (Table 17) or mixture of Isofol®16 and TOPO (Table 18), with and without acid wash. R-0, R-1, etc. refer to the number of recycles the cells have undergone. In the absence of acid wash, a gradual drop in three parameters (isobutanol titer, total sugar consumed, and specific sugar uptake rate) was observed after recycle 7. A drop in isobutanol titer, total sugar consumption rate, and specific sugar uptake was observed after recycle 3 in the presence of acid wash under the conditions tested. At the end of cycle 6, the acid wash cells had 40% of the sugar consumption rate as that of the control. The results showed that extractant Isofol®16 or extractant mixture Isofol®16+TOPO do not negatively impact isobutanol production without acid wash.

This example demonstrates the restoration of sugar consumption rate and isobutanol production in isobutanologen PNY1775. The cells were centrifuged at 4000 rpm for 5 minutes at the end of acid wash phase of recycle 7 and in the presence of Isofol® 16. Medium was carefully removed without dislodging the pellet and 5 mL CIG#2 medium was added. The cells were incubated at 30° C. and at 200 rpm for 4 h. This cell treatment with a nutrient rich medium is referred to as the rejuvenation phase. After the rejuvenation phase, the cells were again centrifuged as above and the pellet was resuspended in fresh production medium (CRP#2).

The effect of rejuvenation on isobutanologen PNY01775 is shown in Table 19. After rejuvenation, the isobutanologen had a sugar consumption rate of 0.52 g/g/h which was five-fold higher as compared to cells that had not been rejuvenated. In addition, sugar consumption rate was restored to a rate of 0.92 g/g/h for the next two cycles.

TABLE 17

| | Isobutanol titer (g/L) | | Total Sugar Consumed (g/L) | | Specific Sugar Uptake Rate (g/g/h) | |
|---|---|---|---|---|---|---|
| | With acid wash | Without Acid wash | With acid wash | Without Acid wash | With Acid wash | Without acid wash |
| R-0 | 3.81 ± 0.12 | 4.05 ± 0.29 | 19.98 | 19.95 | 0.89 | 0.89 |
| R-1 | 5.14 ± 0.31 | 5.45 ± 0.31 | 24.92 | 25.27 | 1.11 | 1.13 |
| R-2 | 5.42 ± 0.24 | 5.49 ± 0.55 | 24.46 | 25.27 | 1.09 | 1.13 |
| R-3 | 4.99 ± 0.24 | 5.73 ± 0.06 | 22.67 | 25.27 | 1.01 | 1.13 |
| R-4 | 4.01 ± 0.42 | 6.05 ± 0.36 | 17.30 | 25.26 | 0.77 | 1.13 |
| R-5 | 3.11 ± 0.07 | 5.89 ± 0.40 | 12.52 | 25.08 | 0.56 | 1.12 |
| R-6 | 2.29 ± 0.21 | 5.55 ± 0.17 | 8.85 | 23.43 | 0.40 | 1.05 |
| R 7 | 1.85 ± 0.09 | 5.22 ± 0.51 | 6.47 | 22.09 | 0.29 | 0.99 |
| R-8 | 1.29 ± 0.10 | 4.39 ± 0.37 | 2.47 | 17.85 | 0.11 | 0.80 |
| R-9 | 1.05 ± 0.07 | 4.33 ± 0.21 | 0.26 | 15.87 | 0.01 | 0.71 |
| R-10 | 0.69 ± 0.13 | 3.36 ± 0.34 | 0.00 | 12.53 | 0.00 | 0.56 |

Example 11

Rejuvenation

TABLE 18

| | Isobutanol titer (g/L) | | Total Sugar Consumed (g/L) | | Specific Sugar Uptake Rate (g/g/h) | |
|---|---|---|---|---|---|---|
| | With acid wash | Without Acid wash | With acid wash | Without Acid wash | With Acid wash | Without acid wash |
| R-0 | 3.56 ± 0.35 | 4.13 ± 0.22 | 19.76 | 21.20 | 0.88 | 0.95 |
| R-1 | 4.61 ± 0.03 | 4.85 ± 0.51 | 24.40 | 24.71 | 1.09 | 1.10 |
| R-2 | 4.63 ± 0.35 | 5.28 ± 0.18 | 22.31 | 25.27 | 1.00 | 1.13 |
| R-3 | 4.17 ± 0.08 | 5.53 ± 0.16 | 19.65 | 25.23 | 0.88 | 1.13 |
| R-4 | 3.42 ± 0.00 | 5.50 ± 0.09 | 14.67 | 24.55 | 0.66 | 1.10 |
| R-5 | 2.46 ± 0.04 | 5.07 ± 0.20 | 8.56 | 21.87 | 0.38 | 0.98 |
| R-6 | 1.69 ± 0.00 | 4.65 ± 0.20 | 5.12 | 20.12 | 0.23 | 0.90 |
| R 7 | 1.26 ± 0.10 | 4.07 ± 0.22 | 1.98 | 18.12 | 0.09 | 0.81 |
| R-8 | 0.69 ± 0.10 | 3.49 ± 0.02 | 0.12 | 13.50 | 0.01 | 0.60 |
| R-9 | 0.41 ± 0.01 | 3.19 ± 0.28 | 0.00 | 10.38 | 0.00 | 0.46 |
| R-10 | 0.21 ± 0.01 | 2.59 ± 0.15 | 0.00 | 7.83 | 0.00 | 0.35 |

TABLE 19

|  | Isobutanol titer (g/L) | | Total Sugar Consumed (g/L) | | Specific Sugar Uptake Rate (g/g/h) | |
| --- | --- | --- | --- | --- | --- | --- |
|  | Without Rejuvenation | With Rejuvenation | Without Rejuvenation | With Rejuvenation | Without Rejuvenation | With Rejuvenation |
| R-8 | 1.29 ± 0.10 | 3.35 ± 0.24 | 2.47 | 11.75 | 0.11 | 0.52 |
| R-9 | 1.05 ± 0.07 | 5.32 ± 0.14 | 0.26 | 20.69 | 0.01 | 0.92 |
| R-10 | 0.69 ± 0.13 | 5.32 ± 0.08 | 0.00 | 20.64 | 0.00 | 0.92 |

Example 12

Cell Recycle and Rejuvenation

This example describes the effect of recycling and rejuvenation on isobutanol titer, residual sugar, and specific sugar uptake rate in isobutanologen PNY1789. PNY01789 cells were streaked from glycerol stock on synthetic complete medium plates (1× yeast nitrogen base without amino acids, 1× amino acid drop-out without histidine and uracil, 1% w/v agar) containing 5 g/L ethanol as carbon source. After 48 h incubation at 30° C., a patch of cells from the plate was inoculated in 20 mL synthetic complete liquid medium in a 125 mL flask containing 2 g/L sucrose and 5 g/L ethanol as carbon source. Cells were grown at 30° C. for 24 h with agitation at 200 rpm. This culture was used to inoculate 500 mL growth medium CIG#2. At this stage, the culture was grown in 100 mL medium in 500 mL flasks with an initial $OD_{600}$ of 0.3-0.5 and incubated at 30° C. at 200 rpm. After 24 h, cells were harvested by centrifugation at 4000 rpm for 5 minutes and resuspended at an initial $OD_{600}$ of 10 in recycle and production medium (CRP#2). The production phase was carried out in 50 mL screw cap tubes containing 10 mL production medium and 5 mL autoclaved Isofol®16 as extractant. Samples for 0 h time point (t=0 h) were collected immediately after adding the production medium and extractant. To avoid the loss of cells during 0 h sampling, tubes were spun at 4000 rpm for 2 minutes prior to sample collection. One milliliter (1 mL) of sample was collected from each phase (aqueous as well as organic extractant phase). The tubes were tilted at an angle of 45° in a tube holder and incubated at 30° C. with agitation at 160 rpm. After 10 h incubation, samples were centrifuged at 4000 rpm for 2 minutes and 1 mL samples were collected from each phase. All samples were stored at −80° C. until further analysis for sugars and metabolites by HPLC (1260 Infinity System, Agilent Life Sciences, Santa Clara, Calif.) using an HPX 87N Aminex® column, 300×7.8 mm (BioRad Laboratories, Hercules, Calif.) and gas chromatography (7890A GC System, Agilent Life Sciences, Santa Clara, Calif.) using HP-INNOWAX column (30 m×0.32 mm and film 0.25 μm, Agilent Life Sciences, Santa Clara, Calif.). A seven hour incubation in production medium (CRP#2) was considered as the production phase. After each production phase, cells were collected by centrifugation and subjected to acid wash.

For acid wash, cells were harvested by centrifugation at 4000 rpm, resuspended in 1 mL acid wash medium (CRP#2 medium with pH adjusted to 2 using sulfuric acid), and mixed by vortexing. Tubes were tilted at an angle of 45' to prevent settling of cells at the bottom and incubated at 30° C. at 200 rpm for 1 h. This phase was considered as acid wash phase. Acid washed cells were re-used (cell recycling, R) for isobutanol production.

For cell recycling, the cells were harvested by centrifugation at 4000 rpm after each acid wash phase and resuspended in 10 mL fresh production medium (CRP#2) and 5 mL autoclaved Isofol® 16.

For rejuvenation, cells were centrifuged at 4000× rpm for 5 minutes at the end recycle 7 of the acid wash phase. Medium was carefully removed without dislodging the pellet and 5 mL CIG#2 medium was added. The cells were incubated at 30° C. and at 200 rpm for 4 h. After the rejuvenation phase, the cells were again centrifuged as above and the pellet was resuspended in fresh production medium (CRP#2). PNY1789 was recycled in presence of Isofol®16 with acid wash. The results are shown in Table 20. In the presence of acid wash, a drop in isobutanol titers, total sugar consumption rate, and specific sugar uptake was observed after recycle 3. At the end of cycle 7 of the acid wash, cells had >30% drop in sugar consumption rate as compared to that of the cycle 1. Rejuvenation after cycle 7 improved the sugar consumption rate two-fold or more in subsequent cycles.

TABLE 20

|  | Isobutanol titer (g/L) | | Total Sugar Consumed (g/L) | | Specific Sugar Uptake Rate (g/g/h) | |
| --- | --- | --- | --- | --- | --- | --- |
|  | Without Rejuvenation | With Rejuvenation | Without Rejuvenation | With Rejuvenation | Without Rejuvenation | With Rejuvenation |
| R-0 | 4.67 ± 0.01 |  | 25.97 |  | 0.81 |  |
| R-1 | 5.37 ± 0.09 |  | 26.10 |  | 0.82 |  |
| R-2 | 5.18 ± 0.14 |  | 26.12 |  | 0.82 |  |
| R-3 | 4.96 ± 0.06 |  | 26.21 |  | 0.82 |  |
| R-4 | 4.88 ± 0.28 |  | 25.88 |  | 0.81 |  |
| R-5 | 4.86 ± 0.31 |  | 25.15 |  | 0.79 |  |
| R-6 | 4.23 ± 0.02 |  | 22.03 |  | 0.69 |  |
| R 7 | 3.47 ± 0.06 |  | 17.88 |  | 0.56 |  |
| R-8 | 2.62 ± 0.10 | 5.35 ± 0.01 | 13.40 | 25.82 | 0.42 | 0.81 |
| R-9 | 1.54 ± 0.08 | 5.52 ± 0.03 | 7.91 | 25.67 | 0.25 | 0.80 |
| R-10 | 1.18 ± 0.00 | 5.39 ± 0.16 | 5.34 | 25.72 | 0.17 | 0.80 |

Example 13

Acid Washing

Isobutanologen strain PNY1775 was grown in synthetic medium (yeast nitrogen base without amino acids and yeast synthetic drop-out media supplement without uracil, histidine, tryptophan, and leucine) supplemented with 76 mg/L tryptophan, 380 mg/L leucine, 100 mM MES pH 6.0, 0.2% sucrose, and 0.5% ethanol in a 125 mL vented flask. Cells were grown at 30° C. with shaking at 250 rpm overnight. Overnight cultures were centrifuged at 4000 rpm for 5 minutes, resuspended in 1 mL CIG#2 medium, and inoculated into 50 mL CIG#2 medium in a 125 mL vented flask. Cells were grown at 30° C. overnight with shaking at 250 rpm in shakers (Innova 44R, New Brunswick Scientific, CT, USA). Overnight cultures were centrifuged at 4000 rpm for 5 minutes, resuspended in 1 mL CRP#2 medium, inoculated into 9 mL CRP#2 medium in 15 mL conical tube, and grown with closed cap in a roller drum at 30° C. After 24 h, culture supernatants (collected using Spin-X centrifuge tube filter units, Costar Cat. No. 8169) were analyzed by HPLC as described in U.S. Patent Application Publication No. 2007/0092957, which is incorporated herein by reference. The isobutanol titer (g/L) was 6.76±0.23 (n=2).

The strain PNY1775 was streaked onto a fresh SE-His-Ura (1% ethanol) plate and incubated at 30° C. for approximately 48 h. Cells were removed from the plate, resuspended in 1 mL SE-His-Ura (1% ethanol) medium in a sterile microfuge tube, and vortexed to have a uniform suspension. Cells were then inoculated in 25 mL SE-His-Ura medium in 125 mL sterile flasks (duplicate flasks) with vented caps and incubated at 30° C. with shaking at 120 rpm. The initial $OD_{600}$ of the cultures was about 0.5. After 20 h incubation, the $OD_{600}$ had reached 3.3. The culture was centrifuged at 4500 rpm for 5 minutes in two 50 mL centrifuge tubes. The supernatant was discarded, and the cells were resuspended in 500 mL CIG#2 medium and divided into four 500 mL flasks each containing 125 mL of culture with an initial $OD_{600}$ of about 0.5. After 22 h incubation, the $OD_{600}$ of each culture was measured and ranged from 3.23 to 3.62. Two of the cultures were centrifuged, pooled, and resuspended in 80 mL CRP#2 and the OD of the culture was 10.02 (6 gdcw/L).

Ten milliliters (10 mL) of this culture was pipetted each into six 15 mL conical screw cap centrifuge tubes and the cultures were incubated at 30° C. in the rotary drum. This generated triplicate samples for both control and acid wash treatment.

The tubes were incubated for the production phase for 7 h. At the end of 7 h, the tubes were centrifuged, and the supernatants were collected with a portion filtered for HPLC analysis. All supernatants were stored at 4° C. The control sample pellets then sat at room temperature for one hour with the tube lids on. The acid wash sample pellets were each resuspended in 1 mL acid wash media. The cells were resuspended with gently mixing by pipetting. The samples were then incubated at 30° C. with shaking at 120 rpm for approximately 50 minutes. At the end of the acid wash incubation, the acid wash cultures were centriguged at 4500 rpm for 3 minutes. The acid wash supernatants were carefully removed with a pipet, as to not disturb any cells, and the supernatant was discarded.

All cell pellets were resuspended in 10 mL fresh CRP#2. The tubes were tightly closed, and the next production phase began with incubation at 30° C. in the rotary drum.

All culture supernatants (collected using Spin-X centrifuge tube filter units, Costar Cat. No. 8169) were analyzed by HPLC (as described in U.S. Patent Application Publication No. 2007/0092957). Sucrose, glucose, and fructose were analyzed by HPLC using an Aminex® column, 300× 7.8 mm (BioRad Laboratories, Hercules, Calif.). The other compounds were analyzed by HPLC using a Shodex™ sugar column, 300 mm L×8 mm ID. Results are shown in Table 21.

TABLE 21

| | | | Acid Wash | | |
|---|---|---|---|---|---|
| Cycle | Isobutanol (g/L) | Yield (g/g) | Cycle | Isobutanol (g/L) | Yield (g/g) |
| C1 | 4.72 | 0.24 | C1 | 4.55 | 0.24 |
| C2 | 5.83 | 0.24 | C2 | 5.67 | 0.24 |
| C3 | 6.26 | 0.24 | C3 | 6.13 | 0.24 |
| C4 | 6.33 | 0.24 | C4 | 6.20 | 0.24 |
| C5 | 6.16 | 0.24 | C5 | 6.10 | 0.23 |
| C6 | 6.21 | 0.24 | C6 | 6.06 | 0.23 |
| C7 | 6.24 | 0.24 | C7 | 6.09 | 0.23 |
| C8 | 6.30 | 0.24 | C8 | 6.03 | 0.23 |
| C9 | 6.16 | 0.24 | C9 | 5.91 | 0.23 |
| C10 | 6.12 | 0.23 | C10 | 5.95 | 0.23 |

The data in Table 21 showed that the sugar utilization rate had improved after two cycles in both control and acid wash treated cultures. In addition, the yield of isobutanol was similar from cycle 1 to 10 in both control and acid treated samples. The concentration of pathway intermediates (αKIV, DHIV, and isobutyric acid) were similar in the various cycles in both control and acid wash demonstrating that the isobutanol biosynthetic pathway enzymes were active and were not inactivated by exposure to low pH.

From the above description, it is apparent that the objects of the present invention have been achieved. While only certain embodiments have been set forth, alternative embodiments and various modifications will be apparent from the above description to those skilled in the art and are within the spirit and scope of the present invention. Those skilled in the art will recognize, or be able to ascertain using no more than routine experimentation, many equivalents to the specific embodiments of the invention described herein. Such equivalents are intended to be encompassed by the following claims.

All publications, patents, and patent applications mentioned in this specification are indicative of the level of skill of those skilled in the art to which this invention pertains, and are herein incorporated by reference to the same extent as if each individual publication, patent, or patent application was specifically and individually indicated to be incorporated by reference for all purposes.

SEQUENCE LISTING (272 sequences)

SEQ ID NO: 1 - protein, 369 aa, Saccharomyces cerevisiae
MVVFEITILGANGGPTEYGTQCFILKPARTEDPELIAVDGGAGMYQLREMLVQGRNENEGDDELVPSFYEHDREPIEFFIDSKLNIQKGLSKSLLQSLKRQGEHFESANTMKKTYEVFQGITDYYITHPHLDHISGLVVNSPSIYEQENSKKKTIWGLPHTIDVLQKHVFNDLIWPDLTAERSRKLKLKCLNPKEVQKCTIFPWDVIPFKVHHGIGVKTGAPVYSTFYIFRDRKSKDCIIVCGDVEQDRRESEESLLEEFWSYVAENIPLVHLKGILVECSCPLSSKPEQLYGHLSPIYLINELSNLNTLYNSSKGLSGLNVIVTHVKSTPAKRDPRLTILEELRFLAEERNLGDLRISIALEGHTLFL

SEQ ID NO: 2 - protein, 369 aa, Saccharomyces cerevisiae; identical to SEQ ID NO: 1

SEQ ID NO: 3 - protein, 376 aa, Vanderwaltozyma polyspora
MSDMFEVTILGASGGPVDGNTQSFMIRPARARDLNAVCIDGGAGLGQIVKCVLNNVGGEESLKRDEMRVESFYENDFESIDLYVDEDLTIEAGFSRGIYDLSSAGRSNTIQKAGALFHGIGEYYITHAHLDHISGAIINSPLAYGTSEDISNDKVFLGLDFTMEALKKHIFNDIIWPNLVRDGTNTINLKSIAERQGYRSNTIPDWQIYPFKVHHGNKINSDTEESVLSTVYLVSDTVSGKCLVVCGDLEYRIAPGGDCVPSEIARFLVDNVPPEKLSGIFVECSNTSSIESDKLYGHLSPIRLIKMAKKLESYYSDRYKDFDSLKLNIIITHVKKIYAEVDPRLQILEELKHHASKVGLTNVRFSMAVEGYTYFL

SEQ ID NO: 4 - protein, 570 aa, Bacillus subtilis
MTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 5 - protein, 1716 aa, Bacillus subtilis
ATGTTGACAAAAGCAACAAAAGAACAAAAATCCCTTGTGAAAAACAGAGGGGCGGAGCTTGTTGTTGATTGCTTAGTGGAGCAAGGTGTCACACATGTATTTGGCATTCCAGGTGCAAAAATTGATGCGGTATTTGACGCTTTACAAGATAAAGGACCTGAAATTATCGTTGCCCGGCACGAACAAAACGCAGCATTCATGGCCCAAGCAGTCGGCCGTTTAACTGGAAAACCGGGAGTCGTGTTAGTCACATCAGGACCGGGTGCCTCTAACTTGGCAACAGGCCTGCTGACAGCGAACACTGAAGGAGACCCTGTCGTTGCGCTTGCTGGAAACGTGATCCGTGCAGATCGTTTAAAACGGACACATCAATCTTTGGATAATGCGGCGCTATTCCAGCCGATTACAAAATACAGTGTAGAAGTTCAAGATGTAAAAAATATACCGGAAGCTGTTACAAATGCATTTAGGATAGCGTCAGCAGGGCAGGCTGGGGCCGCTTTTGTGAGCTTTCCGCAAGATGTTGTGAATGAAGTCACAAATACGAAAAACGTGCGTGCTGTTGCAGCGCCAAAACTCGGTCCTGCAGCAGATGATGCAATCAGTGCGGCCATAGCAAAAATCCAAACAGCAAAACTTCCTGTCGTTTTGGTCGGCATGAAAGGCGGAAGACCGGAAGCAATTAAAGCGGTTCGCAAGCTTTTGAAAAAGGTTCAGCTTCCATTTGTTGAAACATATCAAGCTGCCGGTACCCTTTCTAGAGATTTAGAGGATCAATATTTTGGCCGTATCGGTTTGTTCCGCAACCAGCCTGGCGATTTACTGCTAGAGCAGGCAGATGTTGTTCTGACGATCGGCTATGACCCGATTGAATATGATCCGAAATTCTGGAATATCAATGGAGACCGGACAATTATCCATTTAGACGAGATTATCGCTGACATTGATCATGCTTACCAGCCTGATCTTGAATTGATCGGTGACATTCCGTCCACGATCAATCATATCGAACACGATGCTGTGAAAGTGGAATTTGCAGAGCGTGAGCAGAAAATCCTTTCTGATTTAAAACAATATATGCATGAAGGTGAGCAGGTGCCTGCAGATTGGAAATCAGACAGAGCGCACCCTCTTGAAATCGTTAAAGAGTTGCGTAATGCAGTCGATGATCATGTTACAGTAACTTGCGATATCGGTTCGCACGCCATTTGGATGTCACGTTATTTCCGCAGCTACGAGCCGTTAACATTAATGATCAGTAACGGTATGCAAACACTCGGCGTTGCGCTTCCTTGGGCAATCGGCGCTTCATTGGTGAAACCGGGAGAAAAAGTGGTTTCTGTCTCTGGTGACGGCGGTTTCTTATTCTCAGCAATGGAATTAGAGACAGCAGTTCGACTAAAAGCACCAATTGTACACATTGTATGGAACGACAGCACATATGACATGGTTGCATTCCAGCAATTGAAAAAATATAACCGTACATCTGCGGTCGATTTCGGAAATATCGATATCGTGAAATATGCGGAAAGCTTCGGAGCAACTGGCTTGCGCGTAGAATCACCAGACCAGCTGGCAGATGTTCTGCGTCAAGGCATGAACGCTGAAGGTCCTGTCATCATCGATGTCCCGGTTGACTACAGTGATAACATTAATTTAGCAAGTGACAAGCTTCCGAAAGAATTCGGGGAACTCATGAAAACGAAAGCTCTCTAG

SEQ ID NO: 6 - protein, 559 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 7 - DNA, 2055 bp, Klebsiella pneumoniae
tcgaccacggggtgctgaccttcggcgaaattcacaagctgatgatcgacctgcccgccgacagcgcgttcctgcaggctaatctgcatcccgataatctcgatgccgccatccgttccgtagaaagttaagggggtcacatggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaagtcatcacaataaggaaagaaaaatgaaaaaagtcgcacttgttaccggcgccggccaggggattggtaaagctatcgcccttcgtctggtgaaggatggatttgccgtggccattgccgattataacgacgccaccgccaaagcggtcgcctccgaaatcaaccaggccggcggccgcgccatggcggtgaaagtggatgtttctgaccgcgaccaggtatttgccgccgtcga

SEQ ID NO: 8 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 9 - DNA, 3220 bp, Lactococcus lactis
tagatccggaaacaactgattacctgagttaacttagcagaaattgcagaagataacggtaatttggatgaagcattaaattacctttatcaaattccggtgaatgatgaaaattatattgctgctttaatcaaaattgctgacttatatcaatttgaagttgattttgaaacagcaatttctaagttagaagaagcaagagaattatcggattctcctctgattacttttgctttggctgagtcctactttgaacaaggtgattattcagctgccattaccgaatatgcaaaactttcagaacgaaaaattttacatgaaacaaaaatttctatttatcaaagaattggtgactcttatgcccaattaggtaattttgagaatgccatatcatttcttgaaaaatcacttgaatttgatgaaaaaccggaaaccttgtataaaattgctcttctttatggagaaactcataatgaaacaagagccattgctaatttcaaacggttagaaaaaatggatgttgaatttttgaactatgaattagcctatgcccaaaccctagaagctaatcaagaatttaaagctgcactagaaatggcaaagaaagggatgaaaaaaaatcctaatgccgttcctctcttacacttcgcttcaaaaatttgtttcaaacttaaggacaaagctgcagcagaacgttatctcgtggatgctttaaatttaccagaattacatgacgaaacagtctttttgcttgctaatttatacttcaacgaagaagattttgaagctgtcattaatcttgaagagcttttagaagatgaacatttattagctaaatggctttttgcaggagcacataaagctttggaaaatgattctgaagcggctgctttgtatgaagaactcattcaaaccaatctgtcagagaatccagagtttttagaagactatattgattttcttaaagaaattggtcaaatttctaaaacagaaccaattattgaacaatatttggaacttgttccagatgatgaaaatatgagaaatttactgacagacttaaaaaataattactgacaaagctgtcagtaattatttttattgtaagctagaaaattcaaaaacttgcgtcaaaataattgtaaaaggttctattatctgataaaatgattgtgaagtaatccaagagattatgaaatatgaattagaacaaatagaggtaaaataaaaaatgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattgattacaatcaagcaatttgtggcataacaaaataaaagaagaaggccttgaacacctaagcgttcagggcctttttttgtgaaataaattagatgaaatttacaatgagttttgtgaaactagcttctagtttgtgaaaaattgcctataattgccgaataaaaatacccatttaccactccaagaggatgcttcaaattagctaaatacccgttttagaggatgcgtaaaaacaacaaaagaggatgagtatagaacgataaaacttttttatgataggttgagagaattgaatataaaatataataagtagaaggcagcaatt

SEQ ID NO: 10 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 11 - protein, 1476 aa, Escherichia coli
ATGGCTAACTACTTCAATACACTGAATCTGCGCCAGCAGCTGGCACAGCTGGGCAAATGTCGCTTTATGGGCCGCGATGAATTCGCCGATGGCGCGAGCTACCTTCAGGGTAAAAAAGTAGTCATCGTCGGCTGTGGCGCACAGGGTCTGAACCAGGGCCTGAACATGCGTGATTCTGGTCTCGATATCTCCTACGCTCTGCGTAAAGAAGCGATTGCCGAGAAGCGCGCGTCCTGGCGTAAAGCGACCGAAAATGGTTTTAAAGTGGGTACTTACGAAGAACTGATCCCACAGGCGGATCTGGTGATTAACCTGACGCCGGACAAGCAGCACTCTGATGTAGTGCGCACCGTACAGCCACTGATGAAAGACGGCGCGGCGCTGGGCTACTCGCACGGTTTCAACATCGTCGAAGTGGGCGAGCAGATCCGTAAAGATATCACCGTAGTGATGGTTGCGCCGAAATGCCCAGGCACCGAAGTGCGTGAAGAGTACAAACGTGGGTTCGGCGTACCGACGCTGATTGCCGTTCACCCGGAAAACGATCCGAAAGGCGAAGGCATGGCGATTGCCAAAGCCTGGGCGGCTGCAACCGGTGGTCACCGTGCGGGTGTGCTGGAATCGTCCTTCGTTGCGGAAGTGAAATCTGACCTGATGGGCGAGCAAACCATCCTGTGCGGTATGTTGCAGGCTGGCTCTCTGCTGTGCTTCGACAAGCTGGTGGAAGAAGGTACCGATCCAGCATACGCAGAAAAACTGATTCAGTTCGGTTGGGAAACCATCACCGAAGCACTGAAACAGGGCGGCATCACCCTGATGATGGACCGTCTCTCTAACCCGGCGAAACTGCGTGCTTATGCGCTTTCTGAACAGCTGAAAGAGATCATGGCACCCCTGTTCCAGAAACATATGGACGACATCATCTCCGGCGAATTCTCTTCCGGTATGATGGCGGACTGGGCCAACGATGATAAGAAACTGCTGACCTGGCGTGAAGAGACCGGCAAAACCGCGTTTGAAACCGCGCCGCAGTATGAAGGCAAAATCGGCGAGCAGGAGTACTTCGATAAAGGCGTACTGATGATTGCGATGGTGAAAGCGGGCGTTGAACTGGCGTTCGAAACCATGGTCGATTCCGGCATCATTGAAGAGTCTGCATATTATGAATCACTGCACGAGCTGCCGCTGATTGCCAACACCATCGCCCGTAAGCGTCTGTACGAAATGAACGTGGTTATCTCTGATACCGCTGAGTACGGTAACTATCTGTTCTCTTACGCTTGTGTGCCGTTGCTGAAACCGTTTATGGCAGAGCTGCAACCGGGCGACCTGGGTAAAGCTATTCCGGAAGGCGCGGTAGATAACGGGCAACTGCGTGATGTGAACGAAGCGATTCGCAGCCATGCGATTGAGCAGGTAGGTAAGAAACTGCGCGGCTATATGACAGATATGAAACGTATTGCTGTTGCGGGTTAA

SEQ ID NO: 12 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 13 - protein, 1188 aa, Saccharomyces cerevisiae
ATGTTGAGAACTCAAGCCGCCAGATTGATCTGCAACTCCCGTGTCATCACTGCTAAGAGAACCTTTGCTTTGGCCACCCGTGCTGCTGCTTACAGCAGACCAGCTGCCCGTTTCGTTAAGCCAATGATCACTACCCGTGGTTTGAAGCAAATCAACTTCGGTGGTACTGTTGAAACCGTCTACGAAAGAGCTGACTGGCCAAGAGAAAAGTTGTTGGACTACTTCAAGAACGACACTTTTGCTTTGATCGGTTACGGTTCCCAAGGTTACGGTCAAGGTTTGAACTTGAGAGACAACGGTTTGAACGTTATCATTGGTGTCCGTAAAGATGGTGCTTCTTGGAAGGCTGCCATCGAAGACGGTTGGGTTCCAGGCAAGAACTTGTTCACTGTTGAAGATGCTATCAAGAGAGGTAGTTACGTTATGAACTTGTTGTCCGATGCCGCTCAATCAGAAACCTGGCCTGCTATCAAGCCATTGTTGACCAAGGGTAAGACTTTGTACTTCTCCCACGGTTTCTCCCCAGTCTTCAAGGACTTGACTCACGTTGAACCACCAAAGGACTTAGATGTTATCTTGGTTGCTCCAAAGGGTTCCGGTAGAACTGTCAGATCTTTGTTCAAGGAAGGTCGTGGTATTAACTCTTCTTACGCCGTCTGGAACGATGTCACCGGTAAGGCTCACGAAAAGGCCCAAGCTTTGGCCGTTGCCATTGGTTCCGGTTACGTTTACCAAACCACTTTCGAAAGAGAAGTCAACTCTGACTTGTACGGTGAAAGAGGTTGTTTAATGGGTGGTATCCACGGTATGTTCTTGGCTCAATACGACGTCTTGAGAGAAAACGGTCACTCCCCATCTGAAGCTTTCAACGAAACCGTCGAAGAAGCTACCCAATCTCTATACCCATTGATCGGTAAGTACGGTATGGATTACATGTACGATGCTTGTTCCACCACCGCCAGAAGAGGTGCTTTGGACTGGTACCCAATCTTCAAGAATGCTTTGAAGCCTGTTTTCCAAGACTTGTACGAATCTACCAAGAACGGTACCGAAACCAAGAGATCTTTGGAATTCAACTCTCAACCTGACTACAGAGAAAAGCTAGAAAAGGAATTAGACACCATCAGAAACATGGAAATCTGGAAGGTTGGTAAGGAAGTCAGAAAGTTGAGACCAGAAAACCAATAA

SEQ ID NO: 14 - protein, 330 aa, Methanococcus maripaludis
MKVFYDSDFKLDALKEKTIAVIGYGSQGRAQSLNMKDSGLNVVVGLRKNGASWNNAKADGHNVMTIEEAAEKADIIHILIPDELQAEVYESQIKPYLKEGKTLSFSHGFNIHYGFIVPPKGVNVVLVAPKSPGKMVRRTYEEGFGVPGLICIEIDATNNAFDIVSAMAKGIGLSRAGVIQTTFKEETETDLFGEQAVLCGGVTELIKAGFETLVEAGYAPEMAYFETCHELKLIVDLIYQKGFKNMWNDVSNTAEYGGLTRRSRIVTADSKAAMKEILREIQDGRFTKEFLLEKQVSYAHLKSMRRLEGDLQIEEVGAKLRKMCGLEKEE

SEQ ID NO: 15 - DNA, 993 bp, Methanococcus maripaludis
atgaaggtattctatgactcagattttaaattagatgctttaaaagaaaaaacaattgcagtaatcggttatggaagtcaaggtagggcacagtccttaaacatgaaagacagcggattaaacgttgttgttggtttaagaaaaaacggtgcttcatggaacaacgctaaagcagacggtcacaatgtaatgaccattgaagaagctgctgaaaaagcggacatcatccacatcttaatacctgatgaattacaggcagaagtttatgaaagccagataaaaccatacctaaaagaaggaaaaacactaagcttttcacatggttttaacatccactatggattcattgttccaccaaaaggagttaacgtggttttagttgctccaaaatcacctggaaaaatggttagaagaacatacgaagaaggtttcggtgttccaggtttaatctgtattgaaattgatgcaacaaacaacgcatttgatattgtttcagcaatggcaaaaggaatcggtttatcaagagctggagttatccagacaactttcaaagaagaaacagaaactgaccttttcggtgaacaagctgttttatgcggtggagttaccgaattaatcaaggcaggatttgaaacactcgttgaagcaggatacgcaccagaaatggcatactttgaaacctgccacgaattgaaattaatcgttgacttaatctaccaaaaaggattcaaaaacatgtggaacgatgtaagtaacactgcagaatacggcggacttacaagaagaagcagaatcgttacagctgattcaaaagctgcaatgaaagaaatcttaagagaaatccaagatggaagattcacaaaagaattccttctcgaaaaacaggtaagctatgctcatttaaaatcaatgagaagactcgaaggagacttacaaatcgaagaagtcggcgcaaaattaagaaaaatgtgcggtcttgaaaaagaagaataa

SEQ ID NO: 16 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 17 - protein, 1476 aa, Bacillus subtilis; identical to SEQ ID NO: 11

SEQ ID NO: 18 - protein, 343 aa, Anaerostipes caccae
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 19 - protein, 343 aa, Anaerostipes caccae
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 20 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 21 - protein, 1851 aa, Escherichia coli
ATGCCTAAGTACCGTTCCGCCACCACCACTCATGGTCGTAATATGGCGGGTGCTCGTGCGCTGTGGCGCGCCACCGGAATGACCGACGCCGATTTCGGTAAGCCGATTATCGCGGTTGTGAACTCGTTCACCCAATTTGTACCGGGTCACGTCCATCTGCGCGATCTCGGTAAACTGGTCGCCGAACAAATTGAAGCGGCTGGCGGCGTTGCCAAAGAGTTCAACACCATTGCGGTGGATGATGGGATTGCCATGGGCCACGGGGGGATGCTTTATTCACTGCCATCTCGCGAACTGATCGCTGATTCCGTTGAGTATATGGTCAACGCCCACTGCGCCGACGCCATGGTCTGCATCTCTAACTGCGACAAAATCACCCCGGGGATGCTGATGGCTTCCCTGCGCCTGAATATTCCGGTGATCTTTGTTTCCGGCGGCCCGATGGAGGCCGGGAAAACCAAACTTTCCGATCAGATCATCAAGCTCGATCTGGTTGATGCGATGATCCAGGGCGCAGACCCGAAAGTATCTGACTCCCAGAGCGATCAGGTTGAACGTTCCGCGTGTCCGACCTGCGGTTCCTGCTCCGGGATGTTTACCGCTAACTCAATGAACTGCCTGACCGAAGCGCTGGGCCTGTCGCAGCCGGGCAACGGCTCGCTGCTGGCAACCCACGCCGACCGTAAGCAGCTGTTCCTTAATGCTGGTAAACGCATTGTTGAATTGACCAAACGTTATTACGAGCAAAACGACGAAAGTGCACTGCCGCGTAATATCGCCAGTAAGGCGGCGTTTGAAAACGCCATGACGCTGGATATCGCGATGGGTGGATCGACTAACACCGTACTTCACCTGCTGGCGGCGGCGCAGGAAGCGGAAATCGACTTCACCATGAGTGATATCGATAAGCTTTCCCGCAAGGTTCCACAGCTGTGTAAAGTTGCGCCGAGCACCCAGAAATACCATATGGAAGATGTTCACCGTGCTGGTGGTGTTATCGGTATTCTCGGCGAACTGGATCGCGCGGGGTTACTGAACCGTGATGTGAAAAACGTACTTGGCCTGACGTTGCCGCAAACGCTGGAACAATACGACGTTATGCTGACCCAGGATGACGCGGTAAAAAATATGTTCCGCGCAGGTCCTGCAGGCATTCGTACCACACAGGCATTCTCGCAAGATTGCCGTTGGGATACGCTGGACGACGATCGCGCCAATGGCTGTATCCGCTCGCTGGAACACGCCTACAGCAAAGACGGCGGCCTGGCGGTGCTCTACGGTAACTTTGCGGAAAACGGCTGCATCGTGAAAACGGCAGGCGTCGATGACAGCATCCTCAAATTCACCGGCCCGGCGAAAGTGTACGAAAGCCAGGACGATGCGGTAGAAGCGATTCTCGGCGGTAAAGTTGTCGCCGGAGATGTGGTAGTAATTCGCTATGAAGGCCCGAAAGGCGGTCCGGGGATGCAGGAAATGCTCTACCCAACCAGCTTCCTGAAATCAATGGGTCTCGGCAAAGCCTGTGCGCTGATCACCGACGGTCGTTTCTCTGGTGGCACCTCTGGTCTTTCCATCGGCCACGTCTCACCGGAAGCGGCAAGCGGCGGCAGCATTGGCCTGATTGAAGATGGTGACCTGATCGCTATCGACATCCCGAACCGTGGCATTCAGTTACAGGTAAGCGATGCCGAACTGGCGGCGCGTCGTGAAGCGCAGGACGCTCGAGGTGACAAAGCCTGGACGCCGAAAAATCGTGAACGTCAGGTCTCCTTTGCCCTGCGTGCTTATGCCAGCCTGGCAACCAGCGCCGACAAAGGCGCGGTGCGCGATAAATCGAAACTGGGGGGTTAA

SEQ ID NO: 22 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 23 - protein, 1131 aa, Saccharomyces cerevisiae
ATGACCTTGGCACCCCTAGACGCCTCCAAAGTTAAGATAACTACCACACAACATGCATCTAAGCCAAAACCGAACAGTGAGTTAGTGTTTGGCAAGAGCTTCACGGACCACATGTTAACTGCGGAATGGACAGCTGAAAAAGGGTGGGGTACCCCAGAGATTAAACCTTATCAAAATCTGTCTTTAGACCCTTCCGCGGTGGTTTTCCATTATGCTTTTGAGCTATTCGAAGGGATGAAGGCTTACAGAACGGTGGACAACAAAATTACAATGTTTCGTCCAGATATGAATATGAAGCGCATGAATAAGTCTGCTCAGAGAATCTGTTTGCCAACGTTCGACCCAGAAGAGTTGATTACCCTAATTGGGAAACTGATCCAGCAAGATAAGTGCTTAGTTCCTGAAGGAAAAGGTTACTCTTTATATATCAGGCCTACATTAATCGGCACTACGGCCGGTTTAGGGGTTTCCACGCCTGATAGAGCCTTGCTATATGTCATTTGCTGCCCTGTGGGTCCTTATTACAAAACTGGATTTAAGGCGGTCAGACTGGAAGCCACTGATTATGCCACAAGAGCTTGGCCAGGAGGCTGTGGTGACAAGAAACTAGGTGCAAACTACGCCCCCTGCGTCCTGCCACAATTGCAAGCTGCTTCAAGGGGTTACCAACAAAATTTATGGCTATTTGGTCCAAATAACAACATTACTGAAGTCGGCACCATGAATGCTTTTTTCGTGTTTAAAGATAGTAAAACGGGCAAGAAGGAACTAGTTACTGCTCCACTAGACGGTACCATTTTGGAAGGTGTTACTAGGGATTCCATTTTAAATCTTGCTAAAGAAAGACTCGAACCAAGTGAATGGACCATTAGTGAACGCTACTTCACTATAGGCGAAGTTACTGAGAGATCCAAGAACGGTGAACTACTTGAAGCCTTTGGTTCTGGTACTGCTGCGATTGTTTCTCCCATTAAGGAAATCGGCTGGAAAGGCGAACAAATTAATATTCCGTTGTTGCCCGGCGAACAAACCGGTCCATTGGCCAAAGAAGTTGCACAATGGATTAATGGAATCCAATATGGCGAGACTGAGCATGGCAATTGGTCAAGGGTTGTTACTGATTTGAACTGA

SEQ ID NO: 24 - protein, 550 aa, Methanococcus maripaludis
MISDNVKKGVIRTPNRALLKACGYTDEDMEKPFIGIVNSFTEVVPGHIHLRTLSEAAKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKYELISLFEGVGEYQVGKITEEELKCIEDCACSGAGSCAGLYTANSMACLTEALGLSLPMCATTHAVDAQKVRLAKKSGSKIVDMVKEDLKPTDILTKEAFENAILVDLALGGSTNTTLHIPAIANEIENKFITLDDFDRLSDEVPHIASIKPGGEHYMIDLHNAGGIPAVLNVLKEKIRDTKTVDGRSILEIAESVKYINYDVIRKVEAPVHETAGLRVLKGNLAPNGCVVKIGAVHPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIEKEINVDLDESVIKERLSKLGEFEPKIKKGYLSRYSKLVSSADEGAVLK

SEQ ID NO: 25 - protein, 1653 aa, Methanococcus maripaludis
ATGATAAGTGATAACGTCAAAAAGGGAGTTATAAGAACTCCAAACCGAGCTCTTTTAAAGGCTTGCGGATATACAGACGAAGACATGGAAAAACCATTTATTGGAATTGTAAACAGCTTTACAGAAGTTGTTCCCGGCCACATTCACTTAAGAACATTATCAGAAGCGGCTAAACATGGTGTTTATGCAAACGGTGGAACACCATTTGAATTTAATACCATTGGAATTTGCGACGGTATTGCAATGGGCCACGAAGGTATGAAATACTCTTTACCTTCAAGAGAAATTATTGCAGACGCTGTTGAATCAATGGCAAGAGCACATGGATTTGATGGTCTTGTTTTAATTCCTACGTGTGATAAAATCGTTCCTGGAATGATAATGGGTGCTTTAAGACTAAACATTCCATTTATTGTAGTTACTGGAGGACCAATGCTTCCCGGAGAATTCCAAGGTAAAAAATACGAACTTATCAGCCTTTTTGAAGGTGTCGGAGAATACCAAGTTGGAAAAATTACTGAAGAAGAGTTAAAGTGCATTGAAGACTGTGCATGTTCAGGTGCTGGAAGTTGTGCAGGGCTTTACACTGCAAACAGTATGGCCTGCCTTACAGAAGCTTTGGGACTCTCTCTTCCAATGTGTGCAACAACGCATGCAGTTGATGCCCAAAAAGTTAGGCTTGCTAAAAAAAGTGGCTCAAAAATTGTTGATATGGTAAAAGAAGACCTAAAACCAACAGACATATTAACAAAAGAAGCTTTTGAAAATGCTATTTTAGTTGACCTTGCACTTGGTGGATCAACAAACACAACATTACACATTCCTGCAATTGCAAATGAAATTGAAAATAAATTCATAACTCTCGATGACTTTGACAGGTTAAGCGATGAAGTTCCACACATTGCATCAATCAAACCAGGTGGAGAACACTACATGATTGATTTACACAATGCTGGAGGTATTCCTGCGGTATTGAACGTTTTAAAAGAAAAAATTAGAGATACAAAAACAGTTGATGGAAGAAGCATTTTGGAAATCGCAGAATCTGTTAAATACATAAATTACGACGTTATAAGAAAAGTGGAAGCTCCGGTTCACGAAACTGCTGGTTTAAGGGTTTTAAAGGGAAATCTTGCTCCAAACGGTTGCGTTGTAAAAATCGGTGCAGTACATCCGAAAATGTACAAACACGATGGACCTGCAAAAGTTTACAATTCCGAAGATGAAGCAATTTCTGCGATACTTGGCGGAAAAATTGTAGAAGGGGACGTTATAGTAATCAGATACGAAGGACCATCAGGAGGCCCTGGAATGAGAGAAATGCTCTCCCCAACTTCAGCAATCTGTGGAATGGGTCTTGATGACAGCGTTGCATTGATTACTGATGGAAGATTCAGTGGTGGAAGTAGGGGCCCATGTATCGGACACGTTTCTCCAGAAGCTGCAGCTGGCGGAGTAATTGCTGCAATTGAAAACGGGGATATCATCAAAATCGACATGATTGAAAAAGAAATAAATGTTGATTTAGATGAATCAGTCATTAAAGAAAGACTCTCAAAACTGGGAGAATTTGAGCCTAAAATCAAAAAAGGCTATTTATCAAGATACTCAAAACTTGTCTCATCTGCTGACGAAGGGGCAGTTTTAAAATAA

SEQ ID NO: 26 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSDGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 27 - protein, 1677 aa, Bacillus subtilis
ATGGCAGAATTACGCAGTAATATGATCACACAAGGAATCGATAGAGCTCCGCACCGCAGTTTGCTTCGTGCAGCAGGGGTAAAAGAAGAGGATTTCGGCAAGCCGTTTATTGCGGTGTGTAATTCATACATTGATATCGTTCCCGGTCATGTTCACTTGCAGGAGTTTGGGAAAATCGTAAAAGAAGCAATCAGAGAAGCAGGGGGCGTTCCGTTTGAATTTAATACCATTGGGGTAGATGATGGCATCGCAATGGGGCATATCGGTATGAGATATTCGCTGCCAAGCCGTGAAATTATCGCAGACTCTGTGGAAACGGTTGTATCCGCACACTGGTTTGACGGAATGGTCTGTATTCCGAACTGCGACAAAATCACACCGGGAATGCTTATGGCGGCAATGCGCATCAACATTCCGACGATTTTTGTCAGCGGCGGACCGATGGCGGCAGGAAGAACAAGTTACGGGCGAAAAATCTCCCTTTCCTCAGTATTCGAAGGGGTAGGCGCCTACCAAGCAGGGAAAATCAACGAAAACGAGCTTCAAGAACTAGAGCAGTTCGGATGCCCAACGTGCGGGTCTTGCTCAGGCATGTTTACGGCGAACTCAATGAACTGTCTGTCAGAAGCACTTGGTCTTGCTTTGCCGGGTAATGGAACCATTCTGGCAACATCTCCGGAACGCAAAGAGTTTGTGAGAAAATCGGCTGCGCAATTAATGGAAACGATTCGCAAAGATATCAAACCGCGTGATATTGTTACAGTAAAAGCGATTGATAACGCGTTTGCACTCGATATGGCGCTCGGAGGTTCTACAAATACCGTTCTTCATACCCTTGCCCTTGCAAACGAAGCCGGCGTTGAATACTCTTTAGAACGCATTAACGAAGTCGCTGAGCGCGTGCCGCACTTGGCTAAGCTGGCGCCTGCATCGGATGTGTTTATTGAAGATCTTCACGAAGCGGGCGGCGTTTCAGCGGCTCTGAATGAGCTTTCGAAGAAAGAAGGAGCGCTTCATTTAGATGCGCTGACTGTTACAGGAAAAACTCTTGGAGAAACCATTGCCGGACATGAAGTAAAGGATTATGACGTCATTCACCCGCTGGATCAACCATTCACTGAAAAGGGAGGCCTTGCTGTTTTATTCGGTAATCTAGCTCCGGACGGCGCTATCATTAAAACAGGCGGCGTACAGAATGGGATTACAAGACACGAAGGGCCGGCTGTCGTATTCGATTCTCAGGACGAGGCGCTTGACGGCATTATCAACCGAAAAGTAAAAGAAGGCGACGTTGTCATCATCAGATACGAAGGGCCAAAAGGCGGACCTGGCATGCCGGAAATGCTGGCGCCAACATCCCAAATCGTTGGAATGGGACTCGGGCCAAAAGTGGCATTGATTACGGACGGACGTTTTTCCGGAGCCTCCCGTGGCCTCTCAATCGGCCACGTATCACCTGAGGCCGCTGAGGGCGGGCCGCTTGCCTTTGTTGAAAACGGAGACCATATTATCGTTGATATTGAAAAACGCATCTTGGATGTACAAGTGCCAGAAGAAGAGTGGGAAAAACGAAAAGCGAACTGGAAAGGTTTTGAACCGAAAGTGAAAACCGGCTACCTGGCACGTTATTCTAAACTTGTGACAAGTGCCAACACCGGCGGTATTATGAAAATCTAG

SEQ ID NO: 28 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 29 - DNA, 1828 bp, Lactococcus lactis
tttaaataagtcaatatcgttgacttatttagaagaaagagttattctttaaatgtcaagttagttgactaaattaaatataaaatatggaggaatgtgatgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatagatatcaacggatgatgaaaagtaaaatagacaaagtccaataattttataaaaagtaaaaacattaggattttcctaatgttttt

SEQ ID NO: 30 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 31 - DNA, 1954 bp, Lactococcus lactis
ctagagttttctttagtcataattcactccttttattagtctattatacttgataattcaaataagtcaatatcgttgacttatttaaagaaaagcgttattctataaatgtcaagttgattgaccaatatataataaaatatggaggaatgcgatgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataatttataaatagtaaaaaacattaggaaatacctaatgtttttttgttgactaaatcaatccctctttatatagaaaaccttagtttctcaaagacaacttaattaagcctgccaaattggaactcgcaaaatgtaatctatcctctgctccta

SEQ ID NO: 32 - protein, 550 aa, Salmonella typhimurium
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 33 - protein, 1653 aa, Salmonella typhimurium
TTATCCCCCGTTGCGGGCTTCCAGCGCCCGGGTCACGGTACGCAGTAATTCCGGCAGATCGGCTTTTGGCAACATCACTTCAATAAATGACAGACGTTGTGGGCGCGCCAACCGTTCGAGGACCTCTGCCAGTTGGATAGCCTGCGTCACCCGCCAGCACTCCGCCTGTTGCGCCGCGTTTAGCGCCGGTGGTATCTGCGTCCAGTTCCAGCTCGCGATGTCGTTATACCGCTGGGCCGCGCCGTGAATGGCGCGCTCTACGGTATAGCCGTCATTGTTGAGCAGCAGGATGACCGGCGCCTGCCCGTCGCGTAACATCGAGCCCATCTCCTGAATCGTGAGCTGCGCCGCGCCATCGCCGATAATCAGAATCACCCGCCGATCGGGACAGGCGGTTTGCGCGCCAAACGCGGCGGGCAAGGAATAGCCGATAGACCCCCACAGCGGCTGTAACACAACTTCCGCGCCGTCAGGAAGCGACAGCGCGGCAGCGCCAAAAGCTGCTGTCCCCTGGTCGACAAGGATAATATCTCCGGGTTTGAGATACTGCTGTAAGGTTTGCCAGAAGCTTTCCTGGGTCAGTTCTCCTTTATCAATCCGCACTGGCTGTCCGGCGGAACGCGTCGGCGGCGGCGCAAAAGCGCATTCCAGGCACAGTTCGCGCAGCGTAGACACCGCCTGCGCCATCGGGAGGTTGAACCAGGTTTCGCCGATGCGCGACGCGTAAGGCTGAATCTCCAGCGTGCGTTCCGCCGGTAATTGTTGGGTAAATCCGGCCGTAAGGGTATCGACAAAACGGGTGCCGACGCAGATAACCCTATCGGCGTCCTCTATGGCCTGACGCACTTCTTTGCTGCTGGCGCCAGCGCTATAGGTGCCAACGAAGTTCGGGTGCTGTTCATCAAAAAGCCCCTTCCCCATCAGTAGTGTCGCATGAGCGATGGGCGTTTCCGCCATCCAGCGCTGCAACAGTGGTCGTAAACCAAAACGCCCGGCAAGAAAGTCGGCCAATAGCGCAATGCGCCGACTGTTCATCAGGCACTGACGGGCGTGATAACGAAAGGCCGTCTCCACGCCGCTTTGCGCTTCATGCACGGGCAACGCCAGCGCCTGCGTAGGTGGGATGGCCGTTTTTTTCGCCACATCGGCGGGCAACATGATGTATCCTGGCCTGCGTGCGGCAAGCATTTCACCCAACACGCGGTCAATCTCGAAACAGGCGTTCTGTTCATCTAATATTGCGCTGGCAGCGGATATCGCCTGACTCATGCGATAAAAATGACGAAAATCGCCGTCACCGAGGGTATGGTGCATCAATTCGCCACGCTGCTGCGCAGCGCTACAGGGCGCGCCGACGATATGCAAGACCGGGACATATTCCGCGTAACTGCCCGCGATACCGTTAATAGCGCTAAGTTCTCCCACGCCAAAGGTGGTGAGTAGCGCTCCAGCGCCCGACATGCGCGCATAGCCGTCCGCGGCATAAGCGGCGTTCAGCTCATTGGCGCATCCCACCCAACGCAGGGTCGGGTGGTCAATCACATGGTCAAGAAACTGCAAGTTATAATCGCCCGGTACGCCAAAAAGATGGCCAATGCCGCATCCTGCCAGTCTGTCCAGCAAATAGTCGGCCACGGTATAGGGGTTTTGCAT

SEQ ID NO: 34 - protein, 554 aa, Clostridium acetobutylicum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 35 - DNA, 1665 bp, Clostridium acetobutylicum
ttgaagagtgaatacacaattggaagatatttgttagaccgtttatcagagttgggtattcggcatatctttggtgtacctggagattacaatctatcctttttagactatataatggagtacaaagggatagattgggttggaaattgcaatgaattgaatgctgggtatgctgctgatggatatgcaagaataaatggaattggagccatacttacaacatttggtgttggagaattaagtgccattaacgcaattgctggggcatacgctgagcaagttccagttgttaaaattacaggtatccccacagcaaaagttagggacaatggattatatgtacaccacacattaggtgacggaaggtttgatcacttttttgaaatgtttagagaagtaacagttgctgaggcattactaagcgaagaaaatgcagcacaagaaattgatcgtgttcttatttcatgctggagacaaaaacgtcctgttcttataaatttaccgattgatgtatatgataaaccaattaacaaaccattaaagccattactcgattatactatttcaagtaacaaagaggctgcatgtgaatttgttacagaaatagtacctataataaatagggcaaaaaagcctgttattcttgcagattatggagtatatcgttaccaagttcaacatgtgcttaaaaacttggccgaaaaaaccggatttcctgtggctacactaagtatgggaaaaggtgttttcaatgaagcacaccctcaatttattggtgtttataatggtgatgtaagttctccttatttaaggcagcgagttgatgaagcagactgcattattagcgttggtgtaaaattgacggattcaaccacagggggattttctcatggattttctaaaaggaatgtaattcacattgatcctttttcaataaaggcaaaaggtaaaaaatatgcacctattacgatgaaagatgctttaacagaattaacaagtaaaattgagcatagaaactttgaggatttagatataaagccttacaaatcagataatcaaaagtattttgcaaaagagaagccaattacacaaaaacgtttttttgagcgtattgctcactttataaaagaaaaagatgtattattagcagaacagggtacatgcttttttggtgcgtcaaccatacaactacccaaagatgcaacttttattggtcaacctttatggggatctattggatacacacttcctgctttattaggttcacaattagctgatcaaaaaaggcgtaatattcttttaattggggatggtgcatttcaaatgacagcacaagaaatttcaacaatgcttcgtttacaaatcaaacctattatttttttaattaataacgatggttatacaattgaacgtgctattcatggtagagaacaagtatataacaatattcaaatgtggcgatatcataatgttccaaaggttttaggtcctaaagaatgcagcttaacctttaaagtacaaagtgaaactgaacttgaaaaggctcttttagtggcagataaggattgtgaacatttgatttttatagaagttgttatggatcgttatgataaacccgagcctttagaacgtctttcgaaacgttttgcaaatcaaaataattag

SEQ ID NO: 36 - DNA, 1641 bp, Macrococcus caseolyticus
atgaaacaacgtatcgggcaatacttgatcgatgccctacacgttaatggtgtcgataagatctttggagtcccaggtgatttcactttagcctttttggacgatatcataagacatgacaacgtggaatgggtgggaaatactaatgagttgaacgccgcttacgccgctgatggttacgctagagttaatggattagccgctgtatctaccacttttggggttggcgagttatctgctgtgaatggtattgctggaagttacgcagagcgtgttcctgtaatcaaaatctcaggcggtccttcatcagttgctcaacaagagggtagatatgtccaccattcattgggtgaaggaatctttgattcatattcaaagatgtacgctcacataaccgcaacaactacaatcttatccgttgacaacgcagtcgacgaaattgatagagttattcattgtgctttgaaggaaaagaggccagtgcatattcatttgcctattgacgtagccttaactgagattgaaatccctcatgcaccaaaagtttacacacacgaatcccagaacgtcgatgcttacattcaagctgttgagaaaaagttaatgtctgcaaaacaaccagtaatcatagcaggtcatgaaatcaattcattcaagttgcacgaacaactggaacagtttgtcaatcagacaaacatccctgttgcacaactttccttgggtaagtctgctttcaatgaagagaatgaacattaccttggtatctacgatggcaaaatcgcaaaggaaaatgtgagagagtacgtcgacaatgctgatgtcatattgaacataggtgccaaactgactgattctgctacagctggattttcctacaagttcgatacaaacaacataatctacattaaccataatgacttcaaagctgaagatgtgatttctgataatgtttcactgattgatcttgtgaatggcctgaattctattgactatagaaatgaaacacactacccatcttatcaaagatctgatatgaaatacgaattgaatgacgcaccacttacacaatctaactatttcaaaatgatgaacgcttttctagaaaaagatgacatcctactagctgaacaaggtacatcctttttcggcgcatatgacttatccctatacaagggaaatcagtttatcggtcagcctttatgggggtcaatagggtatacttttccatctttactaggaagtcaactagcagacatgcataggagaaacattttgcttataggcgatggtagtttacaacttactgttcaagccctaagtacaatgattagaaaggatatcaaaccaatcattttcgttatcaataacgacggttacaccgtcgaaagacttatccacggcatggaagagccatacaatgatatccaaatgtggaactacaagcaattgccagaagtatttggtggaaaagatactgtaaaagttcatgatgctaaaacctccaacgaactgaaaactgtaatggattctgttaaagcagacaaagatcacatgcatttcattgaagtgcatatggcagtagaggacgccccaaagaagttgattgatatagctaaagcctttagtgatgctaacaagtaa

SEQ ID NO: 37 - DNA, 1647 bp, Listeria grayi
atgtacaccgtcggccaatacttagtagaccgcttagaagagatcggcatcgataaggtttttggtgtcccgggtgactacaacctgacctttttggactacatccagaaccacgaaggtctgagctggcaaggtaatacgaatgaactgaatgccgcgtacgcagctgatggctatgctcgtgaacgcggtgttagcgctttggtcacgaccttcggcgttggtgagctgtccgcaatcaatggcaccgcaggtagcttcgcggagcaagttccggtgattcatatcgtgggcagcccgaccatgaatgttcagagcaacaagaaactggttcatcacagcctgggtatgggcaactttcacaacttcagcgagatggcgaaagaagtcaccgccgcaaccacgatgctgacggaagagaatgcggcgtcggagattgatcgtgttctggaaaccgccctgctggagaaacgcccagtgtacatcaatctgccgatcgacattgctcacaaggcgatcgtcaagccggcgaaagccctgcaaaccgagaagagctctggcgagcgtgaggcacaactggcggagatcattctgagccatctggagaaggctgcacagccgattgtgattgcgggtcacgagatcgcgcgcttccagatccgtgagcgtttcgagaattggattaatcaaacgaaactgccggtgaccaatctggcctacggcaagggtagcttcaacgaagaaaacgagcatttcattggtacctattatcctgcatttagcgataagaacgtgctggactacgtggataactccgactttgtcctgcactttggtggtaaaatcattgataacagcacctccagcttctcccaaggcttcaaaaccgagaacaccctgactgcggcgaacgatatcattatgctgccggacggtagcacgtattctggtattagcctgaatggcctgctggccgagctggaaaaactgaatttcacgtttgccgacaccgcagcaaagcaggcggagttggcggtgtttgagccgcaggctgaaaccccgttgaaacaggaccgttttcaccaggcggtgatgaattttctgcaagctgacgatgtcctggttacggaacagggcacctcttcttttggcttgatgctggcgcctctgaaaaagggtatgaacttgatctcgcaaacgctgtggggtagcattggttacacgttgccggcgatgattggtagccaaattgcggcaccggagcgtcgtcatatcctgagcattggtgatggtagctttcagctgactgcgcaggaaatgagcaccattttccgtgagaaactgaccccagtcatcttcatcattaacaatgatggctataccgttgagcgtgcgatccatggcgaagatgaaagctataacgacattccgacgtggaacttgcaactggtggcggaaaccttcggtggtgacgccgaaaccgtcgacactcacaatgtgttcacggagactgatttcgccaacaccctggcggcaattgacgcgacgccgcagaaagcacacgttgtggaagttcacatggaacaaatggatatgccggagagcctgcgccagatcggtctggcactgtccaagcagaatagctaa

SEQ ID NO: 38 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 39 - protein, 939 aa, Saccharomyces cerevisiae
ATGCCTGCTACGTTAAAGAATTCTTCTGCTACATTAAAACTAAATACTGGTGCCTCCATTCCAGTGTTGGGTTTCGGCACTTGGCGTTCCGTTGACAATAACGGTTACCATTCTGTAATTGCAGCTTTGAAAGCTGGATACAGACACATTGATGCTGCGGCTATCTATTTGAATGAAGAAGAAGTTGGCAGGGCTATTAAAGATTCCGGAGTCCCTCGTGAGGAAATTTTTATTACTACTAAGCTTTGGGGTACGGAACAACGTGATCCGGAAGCTGCTCTAAACAAGTCTTTGAAAAGACTAGGCTTGGATTATGTTGACCTATATCTGATGCATTGGCCAGTGCCTTTGAAAACCGACAGAGTTACTGATGGTAACGTTCTGTGCATTCCAACATTAGAAGATGGCACTGTTGACATCGATACTAAGGAATGGAATTTTATCAAGACGTGGGAGTTGATGCAAGAGTTGCCAAAGACGGGCAAAACTAAAGCCGTTGGTGTCTCTAATTTTTCTATTAACAACATTAAAGAATTATTAGAATCTCCAAATAACAAGGTGGTACCAGCTACTAATCAAATTGAAATTCATCCATTGCTACCACAAGACGAATTGATTGCCTTTTGTAAGGAAAAGGGTATTGTTGTTGAAGCCTACTCACCATTTGGGAGTGCTAATGCTCCTTTACTAAAAGAGCAAGCAATTATTGATATGGCTAAAAAGCACGGCGTTGAGCCAGCACAGCTTATTATCAGTTGGAGTATTCAAAGAGGCTACGTTGTTCTGGCCAAATCGGTTAATCCTGAAAGAATTGTATCCAATTTTAAGATTTTCACTCTGCCTGAGGATGATTTCAAGACTATTAGTAACCTATCCAAAGTGCATGGTACAAAGAGAGTCGTTGATATGAAGTGGGGATCCTTCCCAATTTTCCAATGA

SEQ ID NO: 40 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 41 - DNA, 1083 bp, Saccharomyces cerevisiae
ctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagccatatggctttagcgataacatttcgtgttgttctggtatagagattgagacaattctaccaccaaccttcatagcctttggcataatgttgaagtcaatgtcggtaagggaggaagcacagactacaatcaggtcgaaggtgtcaaagtacttttcaccccaatcaccttcttctaatgtagcaatgtagtgatcggcgcccatcttcattgcatcttctctttttctcgaagaacgagaaataacatacgtctctgcccccatggctttggaaatcaatgtacccatactgccgataccaccaagaccaactataccaacttttttacctggaccgcaaccgttacgaaccaatggagagtacacagtcaaaccaccacataatagtggagcagccaaatgtgatggaatattctctgggataggcaccacaaaatgttcatgaactctgacgtagtttgcatagccaccctgcgacacatagccgtcttcataaggctgactgtatgtggtaacaaacttggtgcagtatggttcattatcattcttacaacggtcacattccaagcatgaaaagacttgagcacctacaccaacacgttgaccgactttcaacccactgtttgacttgggccctagcttgacaactttaccaacgatttcatgaccaacgactagcggcatcttcatattgccccaatgaccagctgcacaatgaatatcactaccgcagacaccacatgcttcgatcttaatgtcaatgtcatgatcgtaaaatggttttgggtcatactttgtcttctttgggtttttccaatcttcgtgtgattgaatagcgataccttcaaatttctcaggataagacat

SEQ ID NO: 42 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 43 - protein, 387 aa, Escherichia coli; identical to SEQ ID NO: 42

SEQ ID NO: 44 - protein, 389 aa, Clostridium acetobutylicum
MLSFDYSIPTKVFFGKGKIDVIGEEIKKYGSRVLIVYGGGSIKRNGIYDRATAILKENNIAFYELSGVEPNPRITTVKKGIEICRENNVDLVLAIGGGSAIDCSKVIAAGVYYDGDTWDMVKDPSKITKVLPIASILTLSATGSEMDQIAVISNMETNEKLGVGHDDMRPKFSVLDPTYTFTVPKNQTAAGTADIMSHTFESYFSGVEGAYVQDGIAEAILRTCIKYGKIAMEKTDDYEARANLMWASSLAINGLLSLGKDRKWSCHPMEHELSAYYDITHGVGLAILTPNWMEYILNDDTLHKFVSYGINVWGIDKNKDNYEIAREAIKNTREYFNSLGIPSKLREVGIGKDKLELMAKQAVRNSGGTIGSLRPINAEDVLEIFKKSY

SEQ ID NO: 45 - protein, 1170 aa, Clostridium acetobutylicum
TTAATAAGATTTTTTAAATATCTCAAGAACATCCTCTGCATTTATTGGTCTTAAACTTCCTATTGTTCCTCCAGAATTTCTAACAGCTTGCTTTGCCATTAGTTCTAGTTTATCTTTTCCTATTCCAACTTCTCTAAGCTTTGAAGGAATACCCAATGAATTAAAGTATTCTCTCGTATTTTTAATAGCCTCTCGTGCTATTTCATAGTTATCTTTGTTCTTGTCTATTCCCCAAACATTTATTCCATAAGAAACAAATTTATGAAGTGTATCGTCATTTAGAATATATTCCATCCAATTAGGTGTTAAAATTGCAAGTCCTACACCATGTGTTATATCATAATATGCACTTAACTCGTGTTCCATAGGATGACAACTCCATTTTCTATCCTTACCAAGTGATAATAGACCATTTATAGCTAAACTTGAAGCCCACATCAAATTAGCTCTAGCCTCGTAATCATCAGTCTTCTCCATTGCTATTTTTCCATACTTTATACATGTTCTTAAGATTGCTTCTGCTATACCGTCCTGCACATAAGCACCTTCAACACCACTAAAGTAAGATTCAAAGGTGTGACTCATAATGTCAGCTGTTCCCGCTGCTGTTTGATTTTTAGGTACTGTAAAAGTATATGTAGGATCTAACACTGAAAATTTAGGTCTCATATCATCATGTCCTACTCCAAGCTTTTCATTAGTCTCCATATTTGAAATTACTGCAATTTGATCCATTTCAGACCCTGTTGCTGAAAGAGTAAGTATACTTGCAATTGGAAGAACTTTAGTTATTTTAGATGGATCTTTAACCATGTCCCATGTATCGCCATCATAATAAACTCCAGCTGCAATTACCTTAGAACAGTCTATTGCACTTCCTCCCCCTATTGCTAATACTAAATCCACATTATTTTCTCTACATATTTCTATGCCTTTTTTTACTGTTGTTATCCTAGGATTTGGCTCTACTCCTGAAAGTTCATAGAAAGCTATATTGTTTTCTTTTAATATAGCTGTTGCTCTATCATATATACCGTTCCTTTTTATACTTCCTCCGCCATAAACTATAAGCACTCTTGAGCCATATTTCTTAATTTCTTCTCCAATTACGTCTATTTTTCCTTTTCCAAAAAAAACTTTAGTTGGTATTGAATAATCAAAACTTAGCAT

SEQ ID NO: 46 - protein, 390 aa, Clostridium acetobutylicum
MVDFEYSIPTRIFFGKDKINVLGRELKKYGSKVLIVYGGGSIKRNGIYDKAVSILEKNSIKFYELAGVEPNPRVTTVEKGVKICRENGVEVVLAIGGGSAIDCAKVIAAACEYDGNPWDIVLDGSKIKRVLPIASILTIAATGSEMDTWAVINNMDTNEKLIAAHPDMAPKFSILDPTYTYTVPTNQTAAGTADIMSHIFEVYFSNTKTAYLQDRMAEALLRTCIKYGGIALEKPDDYEARANLMWASSLAINGLLTYGKDTNWSVHLMEHELSAYYDITHGVGLAILTPNWMEYILNNDTVYKFVEYGVNVWGIDKEKNHYDIAHQAIQKTRDYFVNVLGLPSRLRDVGIEEEKLDIMAKESVKLTGGTIGNLRPVNASEVLQIFKKSV

SEQ ID NO: 47 - protein, 1173 aa, Clostridium acetobutylicum
GTGGTTGATTTCGAATATTCAATACCAACTAGAATTTTTTTCGGTAAAGATAAGATAAATGTACTTGGAAGAGAGCTTAAAAAATATGGTTCTAAAGTGCTTATAGTTTATGGTGGAGGAAGTATAAAGAGAAATGGAATATATGATAAAGCTGTAAGTATACTTGAAAAAAACAGTATTAAATTTTATGAACTTGCAGGAGTAGAGCCAAATCCAAGAGTAACTACAGTTGAAAAAGGAGTTAAAATATGTAGAGAAAATGGAGTTGAAGTAGTACTAGCTATAGGTGGAGGAAGTGCAATAGATTGCGCAAAGGTTATAGCAGCAGCATGTGAATATGATGGAAATCCATGGGATATTGTGTTAGATGGCTCAAAAATAAAAAGGGTGCTTCCTATAGCTAGTATATTAACCATTGCTGCAACAGGATCAGAAATGGATACGTGGGCAGTAATAAATAATATGGATACAAACGAAAAACTAATTGCGGCACATCCAGATATGGCTCCTAAGTTTTCTATATTAGATCCAACGTATACGTATACCGTACCTACCAATCAAACAGCAGCAGGAACAGCTGATATTATGAGTCATATATTTGAGGTGTATTTTAGTAATACAAAAACAGCATATTTGCAGGATAGAATGGCAGAAGCGTTATTAAGAACTTGTATTAAATATGGAGGAATAGCTCTTGAGAAGCCGGATGATTATGAGGCAAGAGCCAATCTAATGTGGGCTTCAAGTCTTGCGATAAATGGACTTTTAACATATGGTAAAGACACTAATTGGAGTGTACACTTAATGGAACATGAATTAAGTGCTTATTACGACATAACACACGGCGTAGGGCTTGCAATTTTAACACCTAATTGGATGGAGTATATTTTAAATAATGATACAGTGTACAAGTTTGTTGAATATGGTGTAAATGTTTGGGGAATAGACAAAGAAAAAAATCACTATGACATAGCACATCAAGCAATACAAAAAACAAGAGATTACTTTGTAAATGTACTAGGTTTACCATCTAGACTGAGAGATGTTGGAATTGAAGAAGAAAAATTGGACATAATGGCAAAGGAATCAGTAAAGCTTACAGGAGGAACCATAGGAAACCTAAGACCAGTAAACGCCTCCGAAGTCCTACAAATATTCAAAAAATCTGTGTAA

SEQ ID NO: 48 - protein, 330 aa, Bacillus subtilis
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 49 - protein, 993 aa, Bacillus subtilis
ATGAGTACAAACCGACATCAAGCACTAGGGCTGACTGATCAGGAAGCCGTTGATATGTATAGAACCATGCTGTTAGCAAGAAAAATCGATGAAAGAATGTGGCTGTTAAACCGTTCTGGCAAAATTCCATTTGTAATCTCTTGTCAAGGACAGGAAGCAGCACAGGTAGGAGCGGCTTTCGCACTTGACCGTGAAATGGATTATGTATTGCCGTACTACAGAGACATGGGTGTCGTGCTCGCGTTTGGCATGACAGCAAAGGACTTAATGATGTCCGGGTTTGCAAAAGCAGCAGATCCGAACTCAGGAGGCCGCCAGATGCCGGGACATTTCGGACAAAAGAAAAACCGCATTGTGACGGGATCATCTCCGGTTACAACGCAAGTGCCGCACGCAGTCGGTATTGCGCTTGCGGGACGTATGGAGAAAAAGGATATCGCAGCCTTTGTTACATTCGGGGAAGGGTCTTCAAACCAAGGCGATTTCCATGAAGGGGCAAACTTTGCCGCTGTCCATAAGCTGCCGGTTATTTTCATGTGTGAAAACAACAAATACGCAATCTCAGTGCCTTACGATAAGCAAGTCGCATGTGAGAACATTTCCGACCGTGCCATAGGCTATGGGATGCCTGGCGTAACTGTGAATGGAAATGATCCGCTGGAAGTTTATCAAGCGGTTAAAGAAGCACGCGAAAGGGCACGCAGAGGAGAAGGCCCGACATTAATTGAAACGATTTCTTACCGCCTTACACCACATTCCAGTGATGACGATGACAGCAGCTACAGAGGCCGTGAAGAAGTAGAGGAAGCGAAAAAAAGTGATCCCCTGCTTACTTATCAAGCTTACTTAAAGGAAACAGGCCTGCTGTCCGATGAGATAGAACAAACCATGCTGGATGAAATTATGGCAATCGTAAATGAAGCGACGGATGAAGCGGAGAACGCCCCATATGCAGCTCCTGAGTCAGCGCTTGATTATGTTTATGCGAAGTAG

SEQ ID NO: 50 - protein, 327 aa, Bacillus subtilis
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 51 - protein, 984 aa, Bacillus subtilis
ATGTCAGTAATGTCATATATTGATGCAATCAATTTGGCGATGAAAGAAGAAATGGAACGAGATTCTCGCGTTTTCGTCCTTGGGGAAGATGTAGGAAGAAAAGGCGGTGTGTTTAAAGCGACAGCGGGACTCTATGAACAATTTGGGGAAGAGCGCGTTATGGATACGCCGCTTGCTGAATCTGCAATCGCAGGAGTCGGTATCGGAGCGGCAATGTACGGAATGAGACCGATTGCTGAAATGCAGTTTGCTGATTTCATTATGCCGGCAGTCAACCAAATTATTTCTGAAGCGGCTAAAATCCGCTACCGCAGCAACAATGACTGGAGCTGTCCGATTGTCGTCAGAGCGCCATACGGCGGAGGCGTGCACGGAGCCCTGTATCATTCTCAATCAGTCGAAGCAATTTTCGCCAACCAGCCCGGACTGAAAATTGTCATGCCATCAACACCATATGACGCGAAAGGGCTCTTAAAAGCCGCAGTTCGTGACGAAGACCCCGTGCTGTTTTTTGAGCACAAGCGGGCATACCGTCTGATAAAGGGCGAGGTTCCGGCTGATGATTATGTCCTGCCAATCGGCAAGGCGGACGTAAAAAGGGAAGGCGACGACATCACAGTGATCACATACGGCCTGTGTGTCCACTTCGCCTTACAAGCTGCAGAACGTCTCGAAAAAGATGGCATTTCAGCGCATGTGGTGGATTTAAGAACAGTTTACCCGCTTGATAAAGAAGCCATCATCGAAGCTGCGTCCAAAACTGGAAAGGTTCTTTTGGTCACAGAAGATACAAAAGAAGGCAGCATCATGAGCGAAGTAGCCGCAATTATATCCGAGCATTGTCTGTTCGACTTAGACGCGCCGATCAAACGGCTTGCAGGTCCTGATATTCCGGCTATGCCTTATGCGCCGACAATGGAAAAATACTTTATGGTCAACCCTGATAAAGTGGAAGCGGCGATGAGAGAATTAGCGGAGTTTTAA

SEQ ID NO: 52 - protein, 424 aa, Bacillus subtilis
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 53 - protein, 1275 aa, Bacillus subtilis
ATGGCAATTGAACAAATGACGATGCCGCAGCTTGGAGAAAGCGTAACAGAGGGGACGATCAGCAAATGGCTTGTCGCCCCCGGTGATAAAGTGAACAAATACGATCCGATCGCGGAAGTCATGACAGATAAGGTAAATGCAGAGGTTCCGTCTTCTTTTACTGGTACGATAACAGAGCTTGTGGGAGAAGAAGGCCAAACCCTGCAAGTCGGAGAAATGATTTGCAAAATTGAAACAGAAGGCGCGAATCCGGCTGAACAAAAACAAGAACAGCCAGCAGCATCAGAAGCCGCTGAGAACCCTGTTGCAAAAAGTGCTGGAGCAGCCGATCAGCCCAATAAAAAGCGCTACTCGCCAGCTGTTCTCCGTTTGGCCGGAGAGCACGGCATTGACCTCGATCAAGTGACAGGAACTGGTGCCGGCGGGCGCATCACACGAAAAGATATTCAGCGCTTAATTGAAACAGGCGGCGTGCAAGAACAGAATCCTGAGGAGCTGAAAACAGCAGCTCCTGCACCGAAGTCTGCATCAAAACCTGAGCCAAAAGAAGAGACGTCATATCCTGCGTCTGCAGCCGGTGATAAAGAAATCCCTGTCACAGGTGTAAGAAAAGCAATTGCTTCCAATATGAAGCGAAGCAAAACAGAAATTCCGCATGCTTGGACGATGATGGAAGTCGACGTCACAAATATGGTTGCATATCGCAACAGTATAAAAGATTCTTTTAAGAAGACAGAAGGCTTTAATTTAACGTTCTTCGCCTTTTTTGTAAAAGCGGTCGCTCAGGCGTTAAAAGAATTCCCGCAAATGAATAGCATGTGGGCGGGGGACAAAATTATTCAGAAAAAGGATATCAATATTTCAATTGCAGTTGCCACAGAGGATTCTTTATTTGTTCCGGTGATTAAAAACGCTGATGAAAAAACAATTAAAGGCATTGCGAAAGACATTACCGGCCTAGCTAAAAAAGTAAGAGACGGAAAACTCACTGCAGATGACATGCAGGGAGGCACGTTTACCGTCAACAACACAGGTTCGTTCGGGTCTGTTCAGTCGATGGGCATTATCAACTACCCTCAGGCTGCGATTCTTCAAGTAGAATCCATCGTCAAACGCCCGGTTGTCATGGACAATGGCATGATTGCTGTCAGAGACATGGTTAATCTGTGCCTGTCATTAGATCACAGAGTGCTTGACGGTCTCGTGTGCGGACGATTCCTCGGACGAGTGAAACAAATTTTAGAATCGATTGACGAGAAGACATCTGTTTACTAA

SEQ ID NO: 54 - protein, 474 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 55 - protein, 1425 aa, Bacillus subtilis
ATGGCAACTGAGTATGACGTAGTCATTCTGGGCGGCGGTACCGGCGGTTATGTTGCGGCCATCAGAGCCGCTCAGCTCGGCTTAAAAACAGCCGTTGTGGAAAAGGAAAAACTCGGGGGAACATGTCTGCATAAAGGCTGTATCCCGAGTAAAGCGCTGCTTAGAAGCGCAGAGGTATACCGGACAGCTCGTGAAGCCGATCAATTCGGAGTGGAAACGGCTGGCGTGTCCCTCAACTTTGAAAAAGTGCAGCAGCGTAAGCAAGCCGTTGTTGATAAGCTTGCAGCGGGTGTAAATCATTTAATGAAAAAAGGAAAAATTGACGTGTACACCGGATATGGACGTATCCTTGGACCGTCAATCTTCTCTCCGCTGCCGGGAACAATTTCTGTTGAGCGGGGAAATGGCGAAGAAAATGACATGCTGATCCCGAAACAAGTGATCATTGCAACAGGATCAAGACCGAGAATGCTTCCGGGTCTTGAAGTGGACGGTAAGTCTGTACTGACTTCAGATGAGGCGCTCCAAATGGAGGAGCTGCCACAGTCAATCATCATTGTCGGCGGAGGGGTTATCGGTATCGAATGGGCGTCTATGCTTCATGATTTTGGCGTTAAGGTAACGGTTATTGAATACGCGGATCGCATATTGCCGACTGAAGATCTAGAGATTTCAAAAGAAATGGAAAGTCTTCTTAAGAAAAAAGGCATCCAGTTCATAACAGGGGCAAAAGTGCTGCCTGACACAATGACAAAAACATCAGACGATATCAGCATACAAGCGGAAAAAGACGGAGAAACCGTTACCTATTCTGCTGAGAAAATGCTTGTTTCCATCGGCAGACAGGCAAATATCGAAGGCATCGGCCTAGAGAACACCGATATTGTTACTGAAAATGGCATGATTTCAGTCAATGAAAGCTGCCAAACGAAGGAATCTCATATTTATGCAATCGGAGACGTAATCGGTGGCCTGCAGTTAGCTCACGTTGCTTCACATGAGGGAATTATTGCTGTTGAGCATTTTGCAGGTCTCAATCCGCATCCGCTTGATCCGACGCTTGTGCCGAAGTGCATTTACTCAAGCCCTGAAGCTGCCAGTGTCGGCTTAACCGAAGACGAAGCAAAGGCGAACGGGCATAATGTCAAAATCGGCAAGTTCCCATTTATGGCGATTGGAAAAGCGCTTGTATACGGTGAAAGCGACGGTTTTGTCAAAATCGTGGCTGACCGAGATACAGATGATATTCTCGGCGTTCATATGATTGGCCCGCATGTCACCGACATGATTTCTGAAGCGGGTCTTGCCAAAGTGCTGGACGCAACACCGTGGGAGGTCGGGCAAACGATTCACCCGCATCCAACGCTTTCTGAAGCAATTGGAGAAGCTGCGCTTGCCGCAGATGGCAAAGCCATTCATTTTTAA

SEQ ID NO: 56 - protein, 410 aa, Pseudomonas putida
MNEYAPLRLHVPEPTGRPGCQTDFSYLRLNDAGQARKPPVDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQATTAEFEAAVIAAQKEAEQYGTLANGHIPSAASMFEDVYKEMPDHLRRQRQELGV

SEQ ID NO: 57 - DNA, 6643 bp, Pseudomonas putida
gcatgcctgcaggccgccgatgaaatggtggaaggtatcggtaggctggccctgctcatcgctgaacacgttacgcccgctgccggtatcgaccaggctctggtgaatatgcatggaactgccaggcgtgcgcgccagcggtttggccatgcacaccacggtcagcccgtgcttgagtgccacttccttgagcaggtgtttgaacaggaaggtctggtcggccagcagcagcgggtcgccatgtagcaagttgatctcgaactggctgacgcccatttcgtgcatgaaggtgtcgcgcggcaggccgagcgcggccatgcactggtacacctcattgaagaacgggcgcaggccgttgttggaactgacactgaacgccgaatggcccagctcgcggcggccgtcggtgcccagcggtggctggaacggctgctgcgggtcactgttgggggcaaacacgaagaactcaagctcggtcgccactaccggtgccagacccaacgctgcgtagcgggcgatcacggccttcagctggccccgggtggacagtgccgagggccggccatccagttcattggcatcgcagatggccagggcgcgaccgtcatcgctccagggcaagcgatgaacctggctgggttccgctaccaacgccaggtcgccgtcgtcgcagccgtagaatttcgccggcgggtagccgcccatgatgcattgcagcagcaccccacgggccatctgcaggcggcggccttcgagaaagccttcggcggtcatcaccttgccgcgtgggacgccgttgaggtcgggggtgacgcattcgatttcatcgatgccctggagctgagcgatgctcatgacgcttgtccttgttgttgtaggctgacaacaacataggctgggggtgtttaaaatatcaagcagcctctcgaacgcctggggcctcttctattcgcgcaaggtcatgccattggccggcaacggcaaggctgtcttgtagcgcacctgtttcaaggcaaaactcgagcggatattcgccacacccggcaaccgggtcaggtaatcgagaaaccgctccagcgcctggatactcggcagcagtacccgcaacaggtagtccgggtcgcccgtcatcaggtagcactccatcacctcgggccgttcggcaatttcttcctcgaagcggtgcagcgactgctctacctgtttttccaggctgacatggatgaacacattcacatccagccccaacgcctcgggcgacaacaaggtcacctgctggcggatcacccccagttcttccatggcccgcacccggttgaaacagggcgtgggcgacaggttgaccgagcgtgccagctcggcgttggtgatgcgggcgttttcctgcaggctgttgagaatgccgatatcggtacgatcgagtttgcgcatgagacaaaatcaccggttttttgtgtttatgcggaatgtttatctgccccgctcggcaaaggcaatcaacttgagagaaaaattctcctgccggaccactaagatgtaggggacgctgacttaccagtcacaagccggtactcagcggcggccgcttcagagctcacaaaaacaaatacccgagcgagcgtaaaaagcatgaacgagtacgcccccctgcgtttgcatgtgcccgagcccaccggccggccaggctgccagaccgatttttcctacctgcgcctgaacgatgcaggtcaagcccgtaaaccccctgtcgatgtcgacgctgccgacaccgccgacctgtcctacagcctggtccgcgtgctcgacgagcaaggcgacgcccaaggcccgtgggctgaagacatcgacccgcagatcctgcgccaaggcatgcgcgccatgctcaagacgcggatcttcgacagccgcatggtggttgcccagcgccagaagaagatgtccttctacatgcagagcctgggcgaagaagccatcggcagcggccaggcgctggcgcttaaccgcaccgacatgtgcttccccacctaccgtcagcaaagcatcctgatggcccgcgacgtgtcgctggtggagatgatctgccagttgctgtccaacgaacgcgaccccctcaagggccgccagctgccgatcatgtactcggtacgcgaggccggcttcttcaccatcagcggcaacctggcgacccagttcgtgcaggcggtcggctgggccatggcctcggcgatcaagggcgataccaagattgcctcggcctggatcggcgacggcgccactgccgaatcggacttccacaccgccctcacctttgcccacgtttaccgcgccccggtgatcctcaacgtggtcaacaaccagtgggccatctcaaccttccaggccatcgccggtggcgagtcgaccaccttcgccggccgtggcgtgggctgcggcatcgcttcgctgcgggtggacggcaacgacttcgtcgccgtttacgccgcttcgcgctgggctgccgaacgtgcccgccgtggtttgggcccgagcctgatcgagtgggtcacctaccgtgccggcccgcactcgacctcggacgacccgtccaagtaccgccctgccgatgactggagccacttcccgctgggtgacccgatcgcccgcctgaagcagcacctgatcaagatcggccactggtccgaagaagaacaccaggccaccacggccgagttcgaagcggccgtgattgctgcgcaaaaagaagccgagcagtacggcaccctggccaacggtcacatcccgagcgccgcctcgatgttcgaggacgtgtacaaggagatgcccgaccacctgcgccgccaacgccaggaactgggggtttgagatgaacgaccacaacaacagcatcaacccggaaaccgccatggccaccactaccatgaccatgatccaggccctgcgctcggccatggatgtcatgcttgagcgcgacgacaatgtggtggtgtacggccaggacgtcggctacttcggcggcgtgttccgctgcaccgaaggcctgcagaccaagtacggcaagtcccgcgtgttcgacgcgcccatctctgaaagcggcatcgtcggcaccgccgtgggcatgggtgcctacggcctgcgcccggtggtggaaatccagttcgctgactacttctacccggcctccgaccagatcgtttctgaaatggcccgcctgcgctaccgttcggccggcgagttcatcgccccgctgaccctgcgtatgccctgcggtggcggtatctatggcggccagacacacagccagagcccggaagcgatgttcactcaggtgtgcggcctgcgcaccgtaatgccatccaacccgtacgacgccaaaggcctgctgattgcctcgatcgaatgcgacgacccggtgatcttcctggagcccaagcgcctgtacaacggcccgttcgacggccaccatgaccgcccggttacgccgtggtcgaaacacccgcacagcgccgtgcccgatggctactacaccgtgccactggacaaggccgccatcacccgccccggcaatgacgtgagcgtgctcacctatggcaccaccgtgtacgtggcccaggtggccgccgaagaaagtggcgtggatgccgaagtgatcgacctgcgcagcctgtggccgctagacctggacaccatcgtcgagtcggtgaaaaagaccggccgttgcgtggtagtacacgaggccacccgtacttgtggctttggcgcagaactggtgtcgctggtgcaggagcactgcttccaccacctggaggcgccgatcgagcgcgtcaccggttgggacaccccctaccctcacgcgcaggaatgggcttacttcccagggccttcgcgggtaggtgcggcattgaaaaaggtcatggaggtctgaatgggcacgcacgtcatcaagatgccggacattggcgaaggcatcgcgcaggtcgaattggtggaatggttcgtcaaggtgggcgacatcatcgccgaggaccaagtggtagccgacgtcatgaccgacaaggccaccgtggaaatcccgtcgccggtcagcggcaaggtgctggccctgggtggccagccaggtgaagtgatggcggtcggcagtgagctgatccgcatcgaagtggaaggcagcggcaaccatgtggatgtgccgcaagccaagccggccgaagtgcctgcggcaccggtagccgctaaacctgaaccacagaaagacgttaaaccggcggcgtaccaggcgtcagccagccacgaggcagcgcccatcgtgccgcgccagccgggcgacaagccgctggcctcgccggcggtgcgcaaacgcgccctcgatgccggcatcgaattgcgttatgtgcacggcagcggcccggccgggcgcatcctgcacgaagacctcgacgcgttcatgagcaaaccgcaaagcgctgccgggcaaacccccaatggctatgccaggcgcaccgacagcgagcaggtgccggtgatcggcctgcgccgcaagatcgcccagcgcatgcaggacgccaagcgccgggtcgcgcacttcagctatgtggaagaaatcgacgtcaccgccctggaagccctgcgccagcagctcaacagcaagcacggcgacagccgcggcaagctgacactgctgccgttcctggtgcgcgccctggtcgtggcactgcgtgacttcccgcagataaacgccacctacgatgacgaagcgcagatcatcacccgccatggcgcggtgcatgtgggcatcgccacccaaggtgacaacggcctgatggtacccgtgctgcgccacgccgaagcgggcagcctgtgggccaatgccggtgagatttcacgcctggccaacgctgcgcgcaacaacaaggccagccgcgaagagctgtccggttcgaccattaccctgaccagcctcggcgccctgggcggcatcgtcagcacgccggtggtcaacaccccggaagtggcgatcgtcggtgtcaaccgcatggttgagcggcccgtggtgatcgacggccagatcgtcgtgcgcaagatgatgaacctgtccagctcgttcgaccaccgcgtggtcgatggcatggacgccgccctgttcatccaggccgtgcgtggcctgctcgaacaacccgcctgcctgttcgtggagtgagcatgcaacagactatccagacaaccctgttgatcatcggcggcggccctggcggctatgtggcggccatccgcgccgggcaactgggcatccctaccgtgctggtggaaggccaggcgctgggcggtacctgcctgaacatcggctgcattccgtccaaggcgctgatccatgtggccgagcagttccaccaggcctcgcgctttaccgaaccctcgccgctgggcatcagcgtggcttcgccacgcctggacatcggccagagcgtggcctggaaagacggcatcgtcgatcgcctgaccactggtgtcgccgccctgctgaaaaagcacggggtgaaggtggtgcacggctgggccaaggtgcttgatggcaagcaggtcgaggtggatggccagcgcatccagtgcgagcacctgttgctggccacgggctccagcagtgtcgaactgccgatgctgccgttgggtgggccggtgatttcctcgaccgaggccctggcaccgaaagccctgccgcaacacctggtggtggtgggcggtggctacatcggcctggagctgggtatcgcctaccgcaagctcggcgcgcaggtcagcgtggtggaagcgcgcgagcgcatcctgccgacttacgacagcgaactgaccgccccggtggccgagtcgctgaaaaagctgggtatcgccctgcaccttggccacagcgtcgaaggttacgaaaatggctgcctgctggccaacgatggcaagggcggacaactgcgcctggaagccgaccgggtgctggtggccgtgggccgccgcccacgcaccaagggcttcaacctggaatgcctggacctgaagatgaatggtgccgcgattgccatcgacgagcgctgccagaccagcatgcacaacgtctgggccatcggcgacgtggccggcgaaccgatgctggcgcaccgggccatggcccagggcgagatggtggccgagatcatcgccggcaaggcacgccgcttcgaacccgctgcgatagccgccgtgtgcttcaccgacccggaagtggtcgtggtcggcaagacgccggaacaggccagtcagcaaggcctggactgcatcgtcgcgcagttcccgttcgccgccaacggccgggccatgagcctggagtcgaaaagcggtttcgtgcgcgtggtcgcgcggcgtgacaaccacctgatcctgggctggcaagcggttggcgtggcggtttccgagctgtccacggcgtttgcccagtcgctggagatgggtgcctgcctggaggatgtggccggtaccatccatgcccacccgaccctgggtgaagcggtacaggaagcggcactgcgtgccctgggccacgccctgcatatctgacactgaagcggccgaggccgatttggcccgccgcgccgagaggcgctgcgggtcttttttatacctg

SEQ ID NO: 58 - protein, 352 aa, Pseudomonas putida
MNDHNNSINPETAMATTTMTMIQALRSAMDVMLERDDNVVVYGQDVGYFGGVFRCTEGLQTKYGKSRVFDAPISESGIVGTAVGMGAYGLRPVVEIQFADYFYPASDQIVSEMARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVSVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 59 - DNA, 6643 bp, Pseudomonas putida; identical to SEQ ID NO: 57

SEQ ID NO: 60 - protein, 423 aa, Pseudomonas putida
MGTHVIKMPDIGEGIAQVELVEWFVKVGDIIAEDQVVADVMTDKATVEIPSPVSGKVLALGGQPGEVMAVGSELIRIEVEGSGNHVDVPQAKPAEVPAAPVAAKPEPQKDVKPAAYQASASHEAAPIVPRQPGDKPLASPAVRKRALDAGIELRYVHGSGPAGRILHEDLDAFMSKPQSAAGQTPNGYARRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 61 - DNA, 6643 bp, Pseudomonas putida; identical to SEQ ID NO: 57

SEQ ID NO: 62 - protein, 459 aa, Pseudomonas putida
MQQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 63 - DNA, 6643 bp, Pseudomonas putida; identical to SEQ ID NO: 57

SEQ ID NO: 64 - protein, 468 aa, Clostridium beijerinckii
MNKDTLIPTTKDLKLKTNVENINLKNYKDNSSCFGVFENVENAINSAVHAQKILSLHYTKEQREKIITEIRKAALENKEVLATMILEETHMGRYEDKILKHELVAKYTPGTEDLTTTAWSGDNGLTVVEMSPYGVIGAITPSTNPTETVICNSIGMIAAGNAVVFNGHPGAKKCVAFAIEMINKAIISCGGPENLVTTIKNPTMESLDAIIKHPLIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYFINKKWVGKDAKLFSDEIDVESPSNIKCIVCEVNANHPFVMTELMMPILPIVRVKDIDEAVKYTKIAEQNRKHSAYIYSKNIDNLNRFEREIDTTIFVKNAKSFAGVGYEAEGFTTFTIAGSTGEGITSARNFTRQRRCVLAG

SEQ ID NO: 65 - DNA, 6558 bp, Clostridium beijerinckii
aagcttaaaatatccataggctattgttaataagactatagcgcttaatactctaagcgcaccatctaaaaaattatacataggaattggataaactccaatcttctccataatacttttcataggtgaaattgatattataattaaggctgcataaagcaaactcatatctccaataaatgtcactatcataggtaatttccttttcatgttcacatactcccccgtattctataataatttacaataaacttccatcacaaataaattataacatatattgtaaatatagttttattattcgcatatttatagataaacaatatataacttagacttatgcaataacctaccgaaagtaaaaacattgttatttcacaggactatgaaaatttcgctgaaagtactaaattgcaggttgcaccactaatgcttgctcccaatttcattgtgacaagcattagttgaacaacctacaattaagagcctttaacagctcatttccaatgcctgctacataaaaatgtttctactttctaatatggtatttacttcaaagtgtaaatcaaattcttaagttgtttatctatatagggttccatattgataacaatacatatctactgtttcaatttcatgaataccagcgatattgaaattttgtaagtttgaatatcattgtgaaaccctatatatcaaatacaatctcaaaattatacaaaaagatcccaacttcacaatatgaatttgagatcttctatcttaacttcttcaatatttttaagattatttatactgcgtgcaaatcttctataagtatcaattatcagctatgtacattgatagtggacttgtaatctgaacagcttatatatttacacttttaagttctcttccactaacccctgctttgaaacttctcataaacaaatcgaaagtacctttaattagctgtgcattctcaaactcagaatttaacttaagtacttcaattgccgcttcgatagtatagagctctccttctgaagcaccttttcttaaagtatattctgatttattaattggatttaatgaaattcttggaagcttctttaagtagtcgctctttcttagtatcttctctgcttctttccatgtgccatctaagataataaatgctggaattttttctgaatctttacatttagactttctttctagaggttcatcatcatccataggaaataatacacgtatttcataatcatcgctattaatatattcaattaatttttcaggagtctttactctctcccaaagaattaactcagttgattctggattcaccaatttcaataatctagcggtatttgaaggcctactaaattctctttctgttgataatatcaatatctttgcttttgtctctattttaggcacaatatcgcagatacaatttattattggcaacccacatttattgcagctctcatataacttagtaatttgcttaactttaaattcagactccattttacctccattattagttggttagtgtgtcatatcttcttgctattactaactgattataacatatgtattcaatatatcactcctagttttcaaagcactggcaatacgaattacaaattaatttctggatttatgtcagtatttcattaataaaaggtcggacttttaagatacttgttttagctattgatcatatttattaaagactatgcatttaatgtataattataatgaatattatcaataatatttattttatattacaatcttacagtctttattctaaatttcactcaaataccaaacgagctttattcataaacaatatataacaataattccaaaataatacgatattttatctgtaacagccatataaaaaaaatatcatatagtcttgtcatttgataacgttttgtcttccttatatttactttttcggtttaataggttgattctgtaaattttagtgataacatatatttgatgacattaaaaatttaatatttcatataaatttttaatgtctattaatttttaaatcacaaggaggaatagttcatgaataaagacacactaatacctacaactaaagatttaaaattaaaaacaaatgttgaaaacattaatttaaagaactacaaggataattcttcatgtttcggagtattcgaaaatgttgaaaatgctataaacagcgctgtacacgcgcaaaagatattatcccttcattatacaaaagaacaaagagaaaaaatcataactgagataagaaaggccgcattagaaaataaagaggttttagctaccatgattctggaagaaacacatatgggaaggtatgaagataaaatattaaagcatgaattagtagctaaatatactcctggtacagaagatttaactactactgcttggtcaggtgataatggtcttacagttgtagaaatgtctccatatggcgttataggtgcaataactccttctacgaatccaactgaaactgtaatatgtaatagcatcggcatgatagctgctggaaatgctgtagtatttaacggacacccaggcgctaaaaaatgtgttgcttttgctattgaaatgataaataaagcaattatttcatgtggcggtcctgagaatttagtaacaactataaaaaatccaactatggaatccctagatgcaattattaagcatcctttaataaaacttctttgcggaactggaggtccaggaatggtaaaaaccctcttaaattctggcaagaaagctataggtgctggtgctggaaatccaccagttattgtagatgataccgctgatatagaaaaggctggtaagagtatcattgaaggctgttcttttgataataatttaccttgtattgcagaaaaagaagtatttgtttttgagaatgttgcagatgatttaatatctaacatgctaaaaaataatgctgtaattataaatgaagatcaagtatcaaaattaatagatttagtattacaaaaaaataatgaaactcaagaatactttataaacaaaaaatgggtaggaaaagatgcaaaattattctcagatgaaatagatgttgagtctccttcaaatattaaatgcatagtctgcgaagtaaatgcaaatcatccatttgtcatgacagaactcatgatgccaatattaccaattgtaagagttaaagatatagatgaagctgttaaatatacaaagatagcagaacaaaatagaaaacatagtgcctatatttattctaaaaatatagacaacctaaatagatttgaaagagaaattgatactactatttttgtaaagaatgctaaatcttttgctggtgttggttatgaagctgaaggatttacaactttcactattgctggatctactggtgaaggcataacctctgcaagaaattttacaagacaaagaagatgtgtacttgccggctaacttcttgctaaatttatacatttattcacataactttaatatgcaatgttcccacaaaatattaaaaactatttagaagggagatattaaatgaataaattagtaaaattaacagatttaaagcgcattttcaaagatggtatgacaattatggttgggggttttttagattgtggaactcctgaaaatattatagatatgctagttgatttaaatataaaaaatctgactattataagcaatgatacagcttttcctaataaaggaataggaaaacttattgtaaatggtcaagtttctaaagtaattgcttcacatattggaactaatcctgaaactgggaaaaaaatgagctctggtgaacttaaagttgagctttctccacaaggaacactgatcgaaagaattcgtgcagctggatctggactcggaggtgtattaactccaaccggacttgggactatcgttgaagaaggtaagaaaaaagttactatcggtggcaaagaatatctattagaacttcctttatccgctgatgtttcattaataaaaggtagcattgtagatgaatttggaaataccttctatagagctgctactaaaaatttcaatccatatatggcaatggctgcaaaaacagttatagttgaagcagaaaatttagttaaatgtgaagatttaaaaagagatgccataatgactcctggcgtattagtagattatatcgttaaggaggcggcttaattgattgtagataaagttttagcaaaagagataattgccaaaagagttgcaaaagaactaaaaaaaggccaactcgtaaaccttggaataggacttccaactttagtagctaattatgtgccaaaagaaatgaacattactttcgaatcagaaaatggcatggttggcatggcacaaatggcctcatcaggtgaaaatgacccagatataataaatgctggtggggaatatgtaacattattacctcaaggtgcattttttgatagttcaacgtcttttgcactaataagaggaggacatgttgatgttgctgttcttggtgctctagaagttgatgaagaaggtaatttagctaactggattgttccaaataaaattgtcccaggtatgggaggcgccatggatttggcaataggcgcaaaaaaaataatagtggcaatgcaacatacaggaaaaggtaaacctaaaatcgtaaaaaaatgtactctcccacttactgctaaggctcaggtagatttaattgttacagaactttgtgtaattgatgtaacaaatgatggtttacttttcagagaaattcataaagatacaactattgatgaaataaaatttttaacagatgcagatttaattattcccgacaacttaaaaattatggatatctaaatcattctattttaaatatataactttaaaaatcttatgtattaaaaactaagaaaagaggttgattattttatgttagaaagtgaagtatctaaacaaattacaactccacttgctgctccagcgtttcctagaggaccatatagatttcacaatagagaatatctaaacattatttatcgaactgatttagatgctcttcgaaaaatagtaccagagccacttgaattagatggagcatatgttaggtttgagatgatggctatgcctgatacaaccggactaggctcatatactgagtgtggtcaagccattccagtaaaatataatgaggttaaaggtgactacttgcatatgatgtacctagataatgaacctgctattgctgttggaagagaaagcagtgcttatcccaaaaagttcggctatccaaagctatttgttgattcagacgccctagttggcgcccttaagtatggtgcattaccggtagttactgcgacgatgggatataagcatgagcccctagatcttaaagaagcctatactcaaattgcaagacccaatttcatgctaaaaatcattcaaggttatgatggtaagccaagaatttgtgaactcatctgtgcagaaaatactgatataactatccacggtgcttggactggaagtgcacgcctacaattatttagccatgcactagctcctcttgctgatttacctgtattagagatcgtatcagcatctcatatcctaacagatttaactcttggaacacctaaggttgtacatgattatctttcagtaaaataaaagcaatatagaataaccactacaaaagtagtggttattctatattttaaatcaaactgtaaaacttaagttttatagtacctaataatattttactaccagcattagattagttaaaatacaaagtttgtggtaaaagtattttagattgcataatagccttctatacttttaacaatataaccaattgctcaccatctgcttagaatatgcttctttaagctctaaaatacatataaaaaagtaggaatttcttattaaaattcctacttatattatatataaatttaatcgttaggttttattcgcattgttcctctttaatttatctcttataacattttattataattgttcatataattaattcaatatactattatatattttcaagcattaataattattcagcatctgtcattacatatgcttccatactttgacttcttattaaatcatagctaatccatccatagccattgattccccagtctttaccccatgaatttattatttttacagcttttttactatcatcataaccaactacgcaaactgcatgaccacctctattttctccatcaatctggtcataaattggattatcagaatttaaattatcaaaatctggatatactgatattccaataactactggatttccagctgctatttgtgcctttattgcattatagtcaccatctggaagttgactccaactttttgctttatatttggctgcattagccttttgttcatctgtaggtgtaacctcccaactatattcactaccatcataaggcatatcagataatgtagtacaaccttgttcttctaataatttaaatgcat

SEQ ID NO: 66 - protein, 862 aa, Clostridium acetobutylicum
MKVTTVKELDEKLKVIKEAQKKFSCYSQEMVDEIFRNAAMAAIDARIELAKAAVLETGMGLVEDKVIKNHFAGEYIYNKYKDEKTCGIIERNEPYGITKIAEPIGVVAAIIPVTNPTSTTIFKSLISLKTRNGIFFSPHPRAKKSTILAAKTILDAAVKSGAPENIIGWIDEPSIELTQYLMQKADITLATGGPSLVKSAYSSGKPAIGVGPGNTPVIIDESAHIKMAVSSIILSKTYDNGVICASEQSVIVLKSIYNKVKDEFQERGAYIIKKNELDKVREVIFKDGSVNPKIVGQSAYTIAAMAGIKVPKTTRILIGEVTSLGEEEPFAHEKLSPVLAMYEADNFDDALKKAVTLINLGGLGHTSGIYADEIKARDKIDRFSSAMKTVRTFVNIPTSQGASGDLYNFRIPPSFTLGCGFWGGNSVSENVGPKHLLNIKTVAERRENMLWFRVPHKVYFKFGCLQFALKDLKDLKKKRAFIVTDSDPYNLNYVDSIIKILEHLDIDFKVFNKVGREADLKTIKKATEEMSSFMPDTIIALGGTPEMSSAKLMWVLYEHPEVKFEDLAIKFMDIRKRIYTFPKLGKKAMLVAITTSAGSGSEVTPFALVTDNNTGNKYMLADYEMTPNMAIVDAELMMKMPKGLTAYSGIDALVNSIEAYTSVYASEYTNGLALEAIRLIFKYLPEAYKNGRTNEKAREKMAHASTMAGMASANAFLGLCHSMAIKLSSEHNIPSGIANALLIEEVIKFNAVDNPVKQAPCPQYKYPNTIFRYARIADYIKLGGNTDEEKVDLLINKIHELKKALNIPTSIKDAGVLEENFYSSLDRISELALDDQCTGANPRFPLTSEIKEMYINCFKKQP

SEQ ID NO: 67 - DNA, 1665 bp, Clostridium acetobutylicum; identical to SEQ ID NO: 35

SEQ ID NO: 68 - protein, 858 aa, Clostridium acetobutylicum
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQCTTANPRYPLISELKDIYIKSF

SEQ ID NO: 69 - DNA, 2589 bp, Clostridium acetobutylicum
atgaaagtcacaacagtaaaggaattagatgaaaaactcaaggtaattaaagaagctcaaaaaaaattctcttgttactcgcaagaaatggttgatgaaatctttagaaatgcagcaatggcagcaatcgacgcaaggatagagctagcaaaagcagctgttttggaaaccggtatgggcttagttgaagacaaggttataaaaaatcattttgcaggcgaatacatctataacaaatataaggatgaaaaaacctgcggtataattgaacgaaatgaaccctacggaattacaaaaatagcagaacctataggagttgtagctgctataatccctgtaacaaaccccacatcaacaacaatatttaaatccttaatatcccttaaaactagaaatggaattttcttttcgcctcacccaagggcaaaaaaatccacaatactagcagctaaaacaatacttgatgcagccgttaagagtggtgccccggaaaatataataggttggatagatgaaccttcaattgaactaactcaatatttaatgcaaaaagcagatataacccttgcaactggtggtccctcactagttaaatctgcttattcttccggaaaaccagcaataggtgttggtccgggtaacaccccagtaataattgatgaatctgctcatataaaaatggcagtaagttcaattatattatccaaaacctatgataatggtgttatatgtgcttctgaacaatctgtaatagtcttaaaatccatatataacaaggtaaaagatgagttccaagaaagaggagcttatataataaagaaaaacgaattggataaagtccgtgaagtgatttttaaagatggatccgtaaaccctaaaatagtcggacagtcagcttatactatagcagctatggctggcataaaagtacctaaaaccacaagaatattaataggagaagttacctccttaggtgaagaagaaccttttgcccacgaaaaactatctcctgttttggctatgtatgaggctgacaattttgatgatgctttaaaaaaagcagtaactctaataaacttaggaggcctcggccatacctcaggaatatatgcagatgaaataaaagcacgagataaaatagatagatttagtagtgccatgaaaaccgtaagaacctttgtaaatatcccaacctcacaaggtgcaagtggagatctatataattttagaataccaccttctttcacgcttggctgcggattttggggaggaaattctgtttccgagaatgttggtccaaaacatcttttgaatattaaaaccgtagctgaaaggagagaaaacatgctttggtttagagttccacataaagtatattttaagttcggttgtcttcaatttgctttaaaagatttaaaagatctaaagaaaaaaagagcctttatagttactgatagtgacccctataatttaaactatgttgattcaataataaaaatacttgagcacctagatattgattttaaagtatttaataaggttggaagagaagctgatcttaaaaccataaaaaaagcaactgaagaaatgtcctcctttatgccagacactataatagctttaggtggtacccctgaaatgagctctgcaaagctaatgtgggtactatatgaacatccagaagtaaaatttgaagatcttgcaataaaatttatggacataagaaagagaatatatactttcccaaaactcggtaaaaaggctatgttagttgcaattacaacttctgctggttccggttctgaggttactccttttgctttagtaactgacaataacactggaaataagtacatgttagcagattatgaaatgacaccaaatatggcaattgtagatgcagaacttatgatgaaaatgccaaagggattaaccgcttattcaggtatagatgcactagtaaatagtatagaagcatacacatccgtatatgcttcagaatacacaaacggactagcactagaggcaatacgattaatatttaaatatttgcctgaggcttacaaaaacggaagaaccaatgaaaaagcaagagagaaaatggctcacgcttcaactatggcaggtatggcatccgctaatgcatttctaggtctatgtcattccatggcaataaaattaagttcagaacacaatattcctagtggcattgccaatgcattactaatagaagaagtaataaaatttaacgcagttgataatcctgtaaaacaagccccttgcccacaatataagtatccaaacaccatatttagatatgctcgaattgcagattatataaagcttggaggaaatactgatgaggaaaaggtagatctcttaattaacaaaatacatgaactaaaaaaagctttaaatataccaacttcaataaaggatgcaggtgttttggaggaaaacttctattcctcccttgatagaatatctgaacttgcactagatgatcaatgcacaggcgctaatcctagatttcctcttacaagtgagataaaagaaatgtatataaattgttttaaaaaacaaccttaa

SEQ ID NO: 70 - protein, 307 aa, Pseudomonas putida
MSKKLKAAIIGPGNIGTDLVMKMLRSEWIEPVWMVGIDPNSDGLKRARDFGMKTTAEGVDGLLPHVLDDDIRIAFDATSAYVHAENSRKLNALGVLMVDLTPAAIGPYCVPPVNLKQHVGRLEMNVNMVTCGGQATIPMVAAVSRVQPVAYAEIVATVSSRSVGPGTRKNIDEFTRTTAGAIEQVGGAREGKAIIVINPAEPPLMMRDTIHCLTDSEPDQAAITASVHAMIAEVQKYVPGYRLKNGPVFDGNRVSIFMEVEGLGDYLPKYAGNLDIMTAAALRTGEMFAEEIAAGTIQLPRRDIALA

SEQ ID NO: 71 - DNA, 2180 bp, Pseudomonas putida
ggtacccctggagccggtcaaggccggcgacttcatgcgcgtcgagatcggcggcatcggcagcgcctccgtgcgcttcacctgatcgaacagaggacaaacccatgagcaagaaactcaaggcggccatcataggccccggcaatatcggtaccgatctggtgatgaagatgctccgttccgagtggattgagccggtgtggatggtcggcatcgaccccaactccgacggcctcaaacgcgcccgcgatttcggcatgaagaccacagccgaaggcgtcgacggcctgctcccgcacgtgctggacgacgacatccgcatcgccttcgacgccacctcggcctatgtgcatgccgagaatagccgcaagctcaacgcgcttggcgtgctgatggtcgacctgaccccggcggccatcggcccctactgcgtgccgccggtcaacctcaagcagcatgtcggccgcctggaaatgaacgtcaacatggtcacctgcggcggccaggccaccatccccatggtcgccgcggtgtcccgcgtgcagccggtggcctacgccgagatcgtcgccaccgtctcctcgcgctcggtcggcccgggcacgcgcaagaacatcgacgagttcacccgcaccaccgccggcgccatcgagcaggtcggcggcgccagggaaggcaaggcgatcatcgtcatcaacccggccgagccgccgctgatgatgcgcgacaccatccactgcctgaccgacagcgagccggaccaggctgcgatcaccgcttcggttcacgcgatgatcgccgaggtgcagaaatacgtgcccggctaccgcctgaagaacggcccggtgttcgacggcaaccgcgtgtcgatcttcatggaagtcgaaggcctgggcgactacctgcccaagtacgccggcaacctcgacatcatgaccgccgccgcgctgcgtaccggcgagatgttcgccgaggaaatcgccgccggcaccattcaactgccgcgtcgcgacatcgcgctggcttgaggagtagcaccatgaatttgcacggcaagagcgtcatcctgcacgacatgagcctgcgcgacggcatgcacgccaagcgccaccagatcagcctggagcagatggtcgcggtcgccaccggcctcgatcaagccggtatgccgctgatcgagatcacccacggcgacggcctcggcggtcgttcgatcaactacggcttcccggcccacagtgacgaggagtacctgcgcgcggtgatcccgcagctcaagcaggccaaagtctcggcgctgctgctgcccggcatcggcaccgtcgaccacctgaagatggccctggactgcggcgtctcgactattcgcgtggccacccactgtaccgaggcggatgtctccgagcagcacatcggcatggcgcgcaagctgggggtcgacaccgtcggcttcctgatgatggcgcacatgatcagcgccgagaaagtcctggagcaggccaagctgatggaaagctatggtgccaactgcatctactgcaccgactcggccggctacatgctgcctgatgaagtcagcgagaaaatcggcctcctgcgcgccgagctgaacccggccaccgaagtcggcttccacggccaccacaacatgggcatggctatcgccaactcgctggccgccatcgaagccggtgccgcgcgcatcgacggctcggtcgccggcctcggcgccggtgccggcaacaccccgctggaagtgttcgtcgcagtgtgcaaacgcatgggcgtggagaccggcatcgacctgtacaagatcatggacgtggccgaggacctggtggtgccgatgatggatcagccgatccgcgtcgaccgcgacgccctgaccctgggctacgccggggtgtacagctcgttcctgctgttcgcccagcgcgccgagaagaaatatggcgtgtcggcccgcgacatcctggtcgaactgggccggcgcggcaccgtcggtggccaggaagacatgatcgaagacctcgccctggacatggcccgggcccgtcagcagcagaaggtgagcgcatgaaccgtaccctgacccgcgaacaggtgctggccctggccgagcacatcgaaaacgccgagctgaatgtccacgacatcggcaaggtgaccaacgattttcc

SEQ ID NO: 72 - protein, 307 aa, Thermus thermophilus
MSERVKVAILGSGNIGTDLMYKLLKNPGHMELVAVVGIDPKSEGLARARALGLEASHEGIAYILERPEIKIVFDATSAKAHVRHAKLLREAGKIAIDLTPAARGPYVVPPVNLKEHLDKDNVNLITCGGQATIPLVYAVHRVAPVLYAEMVSTVASRSAGPGTRQNIDEFTFTTARGLEAIGGAKKGKAIIILNPAEPPILMTNTVRCIPEDEGFDREAVVASVRAMEREVQAYVPGYRLKADPVFERLPTPWGERTVVSMLLEVEGAGDYLPKYAGNLDIMTASARRVGEVFAQHLLGKPVEEVVA

SEQ ID NO: 73 - protein, 924 aa, Thermus thermophilus
ATGTCCGAAAGGGTTAAGGTAGCCATCCTGGGCTCCGGCAACATCGGGACGGACCTGATGTACAAGCTCCTGAAGAACCCGGGCCACATGGAGCTTGTGGCGGTGGTGGGGATAGACCCCAAGTCCGAGGGCCTGGCCCGGGCGCGGGCCTTAGGGTTAGAGGCGAGCCACGAAGGGATCGCCTACATCCTGGAGAGGCCGGAGATCAAGATCGTCTTTGACGCCACCAGCGCCAAGGCCCACGTGCGCCACGCCAAGCTCCTGAGGGAGGCGGGGAAGATCGCCATAGACCTCACGCCGGCGGCCCGGGGCCCTTACGTGGTGCCCCCGGTGAACCTGAAGGAACACCTGGACAAGGACAACGTGAACCTCATCACCTGCGGGGGGCAGGCCACCATCCCCCTGGTCTACGCGGTGCACCGGGTGGCCCCCGTGCTCTACGCGGAGATGGTCTCCACGGTGGCCTCCCGCTCCGCGGGCCCCGGCACCCGGCAGAACATCGACGAGTTCACCTTCACCACCGCCCGGGGCCTGGAGGCCATCGGGGGGGCCAAGAAGGGGAAGGCCATCATCATCCTGAACCCGGCGGAACCCCCCATCCTCATGACCAACACCGTGCGCTGCATCCCCGAGGACGAGGGCTTTGACCGGGAGGCCGTGGTGGCGAGCGTCCGGGCCATGGAGCGGGAGGTCCAGGCCTACGTGCCCGGCTACCGCCTGAAGGCGGACCCGGTGTTTGAGAGGCTTCCCACCCCCTGGGGGGAGCGCACCGTGGTCTCCATGCTCCTGGAGGTGGAGGGGGCGGGGGACTATTTGCCCAAATACGCCGGCAACCTGGACATCATGACGGCTTCTGCCCGGAGGGTGGGGGAGGTCTTCGCCCAGCACCTCCTGGGGAAGCCCGTGGAGGAGGTGGTGGCGTGA

SEQ ID NO: 74 - protein, 417 aa, Escherichia coli
MTFSLFGDKFTRHSGITLLMEDLNDGLRTPGAIMLGGGNPAQIPEMQDYFQTLLTDMLESGKATDALCNYDGPQGKTELLTLLAGMLREKLGWDIEPQNIALTNGSQSAFFYLFNLFAGRRADGRVKKVLFPLAPEYIGYADAGLEEDLFVSARPNIELLPEGQFKYHVDFEHLHIGEETGMICVSRPTNPTGNVITDEELLKLDALANQHGIPLVIDNAYGVPFPGIIFSEARPLWNPNIVLCMSLSKLGLPGSRCGIIIANEKIITAITNMNGIISLAPGGIGPAMMCEMIKRNDLLRLSETVIKPFYYQRVQETIAIIRRYLPENRCLIHKPEGAIFLWLWFKDLPITTKQLYQRLKARGVLMVPGHNFFPGLDKPWPHTHQCMRMNYVPEPEKIEAGVKILAEEIERAWAESH

SEQ ID NO: 75 - protein, 417 aa, Escherichia coli; identical to SEQ ID NO: 74

SEQ ID NO: 76 - protein, 425 aa, Bacillus licheniformis
MKPPLSKIGEKMIEKTGVRAVMSDIQEVLAGGERSYINLSAGNPMILPGVSAMWKSALADLLDDDRFSSVIGQYGSSYGTDELIASVVRFFSERYSAGIRKENVLITAGSQQLFFLAINSFCGMGSGSVMKKALIPMLPDYSGYSGAALEREMIEGIPPLISKLDDHTFRYELDRKGFLERMRIGAVLLSRPNNPCGNILPKEDVAFISDACREANVPLFIDSAYAPPFPAIHFIDMEPIFNEQIIHCMSLSKAGLPGERIGIAIGPSRYIQAMEAFQSNAAIHSSRLGQYMAASVLNDGRLADVSLNEVRPYYRNKFMLLKETLLCKMPEDIKWYLHQGEGSLFGWLWFEDLPVTDAALYEYMKADGVIIVPGSSFFHRQSRRLAHSHQCIRISLTAADEDIIRGIDVLAKIAKGVYEKQVEYL

SEQ ID NO: 77 - protein, 1278 aa, Bacillus licheniformis
TTATAAGTATTCAACCTGTTTCTCATATACACCCTTCGCAATTTTAGCTAAAACATCGATTCCCCTTATAATATCTTCATCCGCCGCGGTTAGGCTGATTCGTATACACTGGTGTGAATGCGCCAGGCGCCGGGATTGACGGTGAAAGAAAGATGATCCGGGAACGATAATGACTCCATCCGCTTTCATATACTCATACAGCGCTGCATCGGTCACCGGCAGGTCTTCAAACCACAGCCATCCGAAAAGCGATCCTTCCCCTTGATGCAGATACCATTTGATGTCTTCAGGCATCTTGCATAAAAGCGTTTCCTTGAGCAGCATGAATTTATTGCGGTAATATGGCCTGACTTCATTCAGCGACACGTCGGCGAGGCGCCCGTCATTCAATACTGATGCAGCCATATACTGCCCCAGCCTTGAAGAATGGATCGCCGCATTCGACTGAAAAGCTTCCATTGCCTGAATATACCGGGACGGCCCGATGGCGATTCCGATCCTTTCGCCAGGCAGGCCGGCTTTTGAAAGGCTCATACAGTGAATGATCTGCTCGTTGAAAATCGGTTCCATGTCGATAAAGTGAATCGCCGGAAAAGGCGGAGCATATGCGGAATCAATGAACAGCGGAACATTCGCTTCTCGGCATGCGTCTGAAATGAATGCTACATCTTCTTTAGGCAAGATGTTTCCGCAAGGATTGTTCGGGCGCGATAGCAAGACAGCACCGATGCGCATCCTCTCTAAAAACCCCTTACGGTCGAGCTCATATCGAAACGTATGATCATCCAATTTCGATATGAGCGGAGGGATCCCCTCAATCATCTCCCGCTCCAGTGCCGCCCCGCTGTATCCCGAATAGTCAGGCAGCATCGGGATCAAGGCTTTTTTCATCACAGATCCGCTTCCCATTCCGCAAAACGAATTGATCGCCAGAAAAAACAGCTGCTGGCTTCCGGCTGTAATCAACACGTTCTCTTTTCGAATGCCGGCGCTATACCGCTCTGAAAAGAAGCGGACAACACTTGCAATCAGTTCATCGGTTCCATAGCTCGATCCGTATTGGCCGATCACCGAAGAAAACCTGTCATCGTCAAGGAGATCGGCAAGAGCCGACTTCCACATGGCTGACACGCCGGGCAAAATCATCGGATTGCCCGCACTTAAATTAATGTATGACCGTTCACCGCCGGCCAGGACTTCCTGAATATCGCTCATCACAGCCCTGACCCCTGTTTTCTCAATCATTTTCTCTCCGATTTTGCTTAATGGCGGCTTCAC

SEQ ID NO: 78 - protein, 309 aa, Escherichia coli
MTTKKADYIWFNGEMVRWEDAKVHVMSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDQVNQ

SEQ ID NO: 79 - DNA, 1476 bp, Escherichia coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 80 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 81 - protein, 376 aa, Saccharomyces cerevisiae; identical to SEQ ID NO: 80

SEQ ID NO: 82 - protein, 330 aa, Methanobacterium thermoautotrophicum
MRLWRALYRPPTITYPSKSPEVIIMSCEASGKIWLNGEMVEWEEATVHVLSHVVHYGSSVFEGIRCYRNSKGSAIFRLREHVKRLFDSAKIYRMDIPYTQEQICDAIVETVRENGLEECYIRPVVFRGYGEMGVHPVNCPVDVAVAAWEWGAYLGAEALEVGVDAGVSTWRRMAPNTMPNMAKAGGNYLNSQLAKMEAVRHGYDEAIMLDYHGYISEGSGENIFLVSEGEIYTPPVSSSLLRGITRDSVIKIARTEGVTVHEEPITREMLYIADEAFFTGTAAEITPIRSVDGIEIGAGRRGPVTKLLQDEFFRIIRAETEDSFGWLTYI

SEQ ID NO: 83 - protein, 993 aa, Methanothermobacter thermautotrophicus
TCAGATGTAGGTGAGCCATCCGAAGCTGTCCTCTGTCTCTGCCCTGATTATCCTGAAGAACTCATCCTGCAGCAGCTTTGTAACGGGACCCCTTCGCCCGGCACCTATCTCTATACCATCAACTGATCTGATGGGTGTTATCTCTGCGGCTGTACCTGTGAAGAAGGCCTCATCTGCGATGTAGAGCATCTCCCTGGTTATGGGTTCCTCATGCACGGTAACACCCTCGGTCCTGGCTATCTTTATTACGGAGTCCCTTGTTATCCCCCTCAGAAGGGATGATGAAACAGGGGGGGTGTAAATTTCACCCTCACTGACGAGGAATATGTTCTCCCCGCTACCCTCACTTATGTAGCCATGGTAGTCCAGCATTATGGCCTCATCATAGCCGTGTCTCACAGCCTCCATCTTGGCAAGCTGTGAGTTGAGGTAGTTACCGCCGGCCTTTGCCATGTTGGGCATTGTGTTTGGTGCCATCCTCCGCCAGGTTGAAACACCAGCATCGACACCAACCTCAAGGGCCTCTGCACCCAGATAGGCCCCCCATTCCCAGGCAGCCACAGCGACGTCCACTGGGCAGTTCACCGGGTGAACACCCATCTCACCGTATCCCCTGAATACCACGGGTCTTATATAGCACTCCTCAAGTCCGTTCTCCCTGACGGTCTCAACTATGGCATCACATATCTGCTCCTGGGTGTAGGGTATGTCCATCCGGTATATCTTTGCAGAATCAAAAAGGCGTTTAACATGCTCCCGCAAACGGAAGATGGCTGACCCCTTACTGTTCCTGTAGCACCTTATTCCCTCAAAGACAGATGATCCATAATGCACAACATGTGAGAGTACGTGGACGGTGGCTTCTTCCCATTCAACCATTTCACCGTTTAACCATATCTTTCCACTGGCTTCGCATGACATGATAATAACCTCAGGTGATTTACTAGGATAGGTTATGGTTGGAGGCCTATATAATGCTCTCCATAACCGCAA

SEQ ID NO: 84 - protein, 364 aa, Streptomyces coelicolor
MTDVNGAPADVLHTLFHSDQGGHEQVVLCQDRASGLKAVIALHSTALGPALGGTRFYPYASEAEAVADALNLARGMSYKNAMAGLDHGGGKAVIIGDPEQIKSEELLLAYGRFVASLGGRYVTACDVGTYVADMDVVARECRWTTGRSPENGGAGDSSVLTSFGVYQGMRAAAQHLWGDPTLRDRTVGIAGVGKVGHHLVEHLLAEGAHVVVTDVRKDVVRGITERHPSVVAVADTDALIRVENLDIYAPCALGGALNDDTVPVLTAKVVCGAANNQLAHPGVEKDLADRGILYAPDYVVNAGGVIQVADELHGFDFDRCKAKASKIYDTTLAIFARAKEDGIPPAAAADRIAEQRMAEARPRP

SEQ ID NO: 85 - DNA, 1095 bp, Streptomyces coelicolor
tcacggccggggacgggcctccgccatccgctgctcggcgatccggtcggccgccgcggccggcggaataccgtcctccttcgcacgtgcgaatatggccagcgtggtgtcgtagatcttcgaggccttcgccttgcaccggtcgaagtcgaacccgtgcagctcgtcggcgacctggatgacaccgccggcgttcaccacatagtccggcgcgtagaggatcccgcggtcggcgaggtccttctcgacgcccgggtgggcgagctggttgttggccgcgccgcacaccaccttggcggtcagcaccggcacggtgtcgtcgttcagcgcgccgccgagcgcgcagggcgcgtagatgtccaggttctccacccggatcagcgcgtcggtgtcggcgacggcgaccaccgacgggtgccgctccgtgatcccgcgcaccacgtccttgcgcacgtccgtgacgacgacgtgggcgccctcggcgagcaggtgctcgaccaggtggtggccgaccttgccgacgcccgcgatgccgacggtgcggtcgcgcagcgtcgggtcgccccacaggtgctgggcggcggcccgcatgccctggtagacgccgaaggaggtgagcacggaggagtcgcccgcgccgccgttctccggggaacgcccggtcgtccagcggcactcgcgggccacgacgtccatgtcggcgacgtaggtgccgacgtcgcacgcggtgacgtagcggccgcccagcgaggcgacgaaccggccgtaggcgaggagcagctcctcgctcttgatctgctccggatcgccgatgatcacggccttgccgccaccgtggtccagaccggccatggcgttcttgtacgacatcccgcgggcgaggttcagcgcgtcggcgacggcctccgcctcgctcgcgtacgggtagaagcgggtaccgccgagcgccgggcccagggcggtggagtggagggcgatcacggccttgaggccgctggcacggtcctggcagagcacgacttgctcatgtcccccctgatccgagtggaacagggtgtgcagtacatcagcaggtgcgccgtttacgtcggtcac

SEQ ID NO: 86 - protein, 364 aa, Bacillus subtilis
MELFKYMEKYDYEQLVFCQDEQSGLKAIIAIHDTTLGPALGGTRMWTYENEEAAIEDALRLARGMTYKNAAAGLNLGGGKTVIIGDPRKDKNEEMFRAFGRYIQGLNGRYITAEDVGTTVEDMDIIHDETDYVTGISPAFGSSGNPSPVTAYGVYRGMKAAAKAAFGTDSLEGKTIAVQGVGNVAYNLCRHLHEEGANLIVTDINKQSVQRAVEDFGARAVDPDDIYSQDCDIYAPCALGATINDDTIKQLKAKVIAGAANNQLKETRHGDQIHEMGIVYAPDYVINAGGVINVADELYGYNAERALKKVEGIYGNIERVLEISQRDGIPAYLAADRLAEERIERMRRSRSQFLQNGHSVLSRR

SEQ ID NO: 87 - protein, 364 aa, Bacillus subtilis; identical to SEQ ID NO: 86

SEQ ID NO: 88 - protein, 594 aa, Streptomyces viridifaciens
MSTSSASSGPDLPFGPEDTPWQKAFSRLRAVDGVPRVTAPSSDPREVYMDIPEIPFSKVQIPPDGMDEQQYAEAESLFRRYVDAQTRNFAGYQVTSDLDYQHLSHYLNRHLNNVGDPYESSSYTLNSKVLERAVLDYFASLWNAKWPHDASDPETYWGYVLTMGSSEGNLYGLWNARDYLSGKLLRRQHREAGGDKASVVYTQALRHEGQSPHAYEPVAFFSQDTHYSLTKAVRVLGIDTFHSIGSSRYPDENPLGPGTPWPTEVPSVDGAIDVDKLASLVRFFASKGYPILVSLNYGSTFKGAYDDVPAVAQAVRDICTEYGLDRRRVYHDRSKDSDFDERSGFWIHIDAALGAGYAPYLQMARDAGMVEEAPPVFDFRLPEVHSLTMSGHKWMGTPWACGVYMTRTGLQMTPPKSSEYIGAADTTFAGSRNGFSSLLLWDYLSRHSYDDLVRLAADCDRLAGYAHDRLLTLQDKLGMDLWVARSPQSLTVRFRQPCADIVRKYSLSCETVYEDNEQRTYVHLYAVPHLTRELVDELVRDLRQPGAFTNAGALEGEAWAGVIDALGRPDPDGTYAGALSAPASGPRSEDGGGS

SEQ ID NO: 89 - DNA, 1785 bp, Streptomyces viridifaciens
gtgtcaacttcctccgcttcttccgggccggacctccccttcgggcccgaggacacgccatggcagaaggccttcagcaggctgcgggcggtggatggcgtgccgcgcgtcaccgcgccgtccagtgatccgcgtgaggtctacatggacatcccggagatccccttctccaaggtccagatccccccggacggaatggacgagcagcagtacgcagaggccgagagcctcttccgccgctacgtagacgcccagacccgcaacttcgcgggataccaggtcaccagcgacctcgactaccagcacctcagtcactatctcaaccggcatctgaacaacgtcggcgatccctatgagtccagctcctacacgctgaactccaaggtccttgagcgagccgttctcgactacttcgcctccctgtggaacgccaagtggccccatgacgcaagcgatccggaaacgtactggggttacgtgctgaccatgggctccagcgaaggcaacctgtacgggttgtggaacgcacgggactatctgtcgggcaagctgctgcggcgccagcaccgggaggccggcggcgacaaggcctcggtcgtctacacgcaagcgctgcgacacgaagggcagagtccgcatgcctacgagccggtggcgttcttctcgcaggacacgcactactcgctcacgaaggccgtgcgggttctgggcatcgacaccttccacagcatcggcagcagtcggtatccggacgagaacccgctgggccccggcactccgtggccgaccgaagtgccctcggttgacggtgccatcgatgtcgacaaactcgcctcgttggtccgcttcttcgccagcaagggctacccgatactggtcagcctcaactacgggtcaacgttcaagggcgcctacgacgacgtcccggccgtggcacaggccgtgcgggacatctgcacggaatacggtctggatcggcggcgggtataccacgaccgcagtaaggacagtgacttcgacgagcgcagcggcttctggatccacatcgatgccgccctgggggcgggctacgctccctacctgcagatggcccgggatgccggcatggtcgaggaggcgccgcccgttttcgacttccggctcccggaggtgcactcgctgaccatgagcggccacaagtggatgggaacaccgtgggcatgcggtgtctacatgacacggaccgggctgcagatgaccccgccgaagtcgtccgagtacatcggggcggccgacaccaccttcgcgggctcccgcaacggcttctcgtcactgctgctgtgggactacctgtcccggcattcgtatgacgatctggtgcgcctggccgccgactgcgaccggctggccggctacgcccacgaccggttgctgaccttgcaggacaaactcggcatggatctgtgggtcgcccgcagcccgcagtccctcacggtgcgcttccgtcagccatgtgcagacatcgtccgcaagtactcgctgtcgtgtgagacggtctacgaagacaacgagcaacggacctacgtacatctctacgccgttccccacctcactcgggaactcgtggatgagctcgtgcgcgatctgcgccagcccggagccttcaccaacgctggtgcactggagggggaggcctgggccggggtgatcgatgccctcggccgcccggaccccgacggaacctatgccggcgccttgagcgctccggcttccggcccccgctccgaggacggcggcgggagctga

SEQ ID NO: 90 - protein, 440 aa, Alcaligenes denitrificans
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 91 - DNA, 1947 bp, Alcaligenes denitrificans
ttcgatggcgcgctgcacggcggccaccagctgctccaccaggggtgggcgcctgcccgcgcgcgcggtcgggctggaaatcgatcatggatgaatctatacagttgtcatgattgcaactatacagttagcccgttttgcggcaattgtatattttcattcgctcgtggacgtccgagaatcggtttgatcgcgccgcccgcccctttccgcgcagcggcgtttcttttcctccggagtctccccatgagcgctgccaaactgcccgacctgtcccacctctggatgccctttaccgccaaccggcagttcaaggcgaacccccgcctgctggcctcggccaagggcatgtactacacgtctttcgacggccgccagatcctggacggcacggccggcctgtggtgcgtgaacgccggccactgccgcgaagaaatcgtctccgccatcgccagccaggccggcgtcatggactacgcgccggggttccagctcggccacccgctggccttcgaggccgccaccgccgtggccggcctgatgccgcagggcctggaccgcgtgttcttcaccaattcgggctccgaatcggtggacaccgcgctgaagatcgccctggcctaccaccgcgcgcgcggcgaggcgcagcgcacccgcctcatcgggcgcgagcgcggctaccacggcgtgggcttcggcggcatttccgtgggcggcatctcgcccaaccgcaagaccttctccggcgcgctgctgccggccgtggaccacctgccgcacacccacagcctggaacacaacgccttcacgcgcggccagcccgagtggggcgcgcacctggccgacgagttggaacgcatcatcgccctgcacgacgcctccaccatcgcggccgtgatcgtcgagcccatggccggctccaccggcgtgctcgtcccgcccaagggctatctcgaaaaactgcgcgaaatcaccgcccgccacggcattctgctgatcttcgacgaagtcatcaccgcgtacggccgcctgggcgaggccaccgccgcggcctatttcggcgtaacgcccgacctcatcaccatggccaagggcgtgagcaacgccgccgttccggccggcgccgtcgcggtgcgccgcgaagtgcatgacgccatcgtcaacggaccgcaaggcggcatcgagttcttccacggctacacctactcggcccacccgctggccgccgccgccgtgctcgccacgctggacatctaccgccgcgaagacctgttcgcccgcgcccgcaagctgtcggccgcgttcgaggaagccgcccacagcctcaagggcgcgccgcacgtcatcgacgtgcgcaacatcggcctggtggccggcatcgagctgtcgccgcgcgaaggcgccccgggcgcgcgcgccgccgaagccttccagaaatgcttcgacaccggcctcatggtgcgctacacgggcgacatcctcgcggtgtcgcctccgctcatcgtcgacgaaaaccagatcggccagatcttcgagggcatcggcaaggtgctcaaggaagtggcttagggtgaacacgccctgagccggccccggcaggaaacgcgccgccgcgcggcggcgcgtccatcgaactcccgcatcgagcttttgcattcatgaagaaaatcacgcatttcatcaacggccagccccacgaaggccgcagcaaccgctacaccgagggcttcaacccggccacgggcgagtcgtctcctcgatctgcctgggcggggccgaagaagtggacctggccgtggcggccgcccgcgcggcctttcccgcctggtccgaaacgccggcgctcaagcgcgcgcgcgtgctgttcaacttcaaggcgctgctggacaagcaccaggacgagctggccgcgctcatcacgcgcgagcacggcaaggtgttttccga

SEQ ID NO: 92 - protein, 443 aa, Ralstonia eutropha
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 93 - DNA, 1341 bp, Ralstonia eutropha
atggccgactcacccaacaacctcgctcacgaacatccttcacttgaacactattggatgccttttaccgccaatcgccaattcaaagcgagccctcgtttactcgcccaagctgaaggtatgtattacacagatatcaatggcaacaaggtattagactctacagcgggcttatggtgttgtaatgctggccatggtcgccgtgagatcagtgaagccgtcagcaaacaaattcggcagatggattacgctccctccttccaaatgggccatcccatcgcttttgaactggccgaacgtttaaccgaactcagcccagaaggactcaacaaagtattctttaccaactcaggctctgagtcggttgataccgcgctaaaaatggctctttgctaccatagagccaatggccaagcgtcacgcacccgctttattggccgtgaaatgggttaccatggcgtaggatttggtgggatctcggtgggtggtttaagcaataaccgtaaagccttcagcggccagctattgcaaggcgtggatcacctgccccacaccttagacattcaacatgccgcctttagtcgtggcttaccgagcctcggtgctgaaaaagctgaggtattagaacaattagtcacactccatggcgccgaaaatattgccgccgttattgttgaacccatgtcaggttctgcaggggtaattttaccacctcaaggctacttaaaacgcttacgtgaaatcactaaaaaacacggcatcttattgattttcgatgaagtcattaccgcatttggccgtgtaggtgcagcattcgccagccaacgttggggcgttattccagacataatcaccacggctaaagccattaataatggcgccatccccatgggcgcagtgtttgtacaggattatatccacgatacttgcatgcaagggccaaccgaactgattgaatttttccacggttatacctattcgggccacccagtcgccgcagcagcagcactcgccacgctctccatctaccaaaacgagcaactgtttgagcgcagttttgagcttgagcggtatttcgaagaagccgttcatagcctcaaagggttaccgaatgtgattgatattcgcaacaccggattagtcgcgggtttccagctagcaccgaatagccaaggtgttggtaaacgcggatacagcgtgttcgagcattgtttccatcaaggcacactcgtgcgggcaacgggcgatattatcgccatgtccccaccactcattgttgagaaacatcagattgaccaaatggtaaatagccttagcgatgcaattcacgccgttggatga

SEQ ID NO: 94 - protein, 446 aa, Shewanella oneidensis
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 95 - DNA, 1341 bp, Shewanella oneidensis; identical to SEQ ID NO: 93

SEQ ID NO: 96 - protein, 448 aa, Pseudomonas putida
MNMPETGPAGIASQLKLDAHWMPYTANRNFQRDPRLIVAAEGNYLVDDHGRKIFDALSGLWTCGAGHTRKEIADAVTRQLSTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGLPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMNQPTPEYAVEFPHGYTYSAHPVACAAGLAALDLLQKENLVQSAAELAPHFEKLLHGVKGTKNIVDIRNYGLAGAIQIAARDGDAIVRPYEAAMKLWKAGFYVRFGGDTLQFGPTFNTKPQELDRLFDAVGETLNLID

SEQ ID NO: 97 - protein, 930 aa, P. putida
ATGACCACGAAGAAAGCTGATTACATTTGGTTCAATGGGGAGATGGTTCGCTGGGAAGACGCGAAGGTGCATGTGATGTCGCACGCGCTGCACTATGGCACTTCGGTTTTTGAAGGCATCCGTTGCTACGACTCGCACAAAGGACCGGTTGTATTCCGCCATCGTGAGCATATGCAGCGTCTGCATGACTCCGCCAAAATCTATCGCTTCCCGGTTTCGCAGAGCATTGATGAGCTGATGGAAGCTTGTCGTGACGTGATCCGCAAAAACAATCTCACCAGCGCCTATATCCGTCCGCTGATCTTCGTCGGTGATGTTGGCATGGGAGTAAACCCGCCAGCGGGATACTCAACCGACGTGATTATCGCTGCTTTCCCGTGGGGAGCGTATCTGGGCGCAGAAGCGCTGGAGCAGGGGATCGATGCGATGGTTTCCTCCTGGAACCGCGCAGCACCAAACACCATCCCGACGGCGGCAAAAGCCGGTGGTAACTACCTCTCTTCCCTGCTGGTGGGTAGCGAAGCGCGCCGCCACGGTTATCAGGAAGGTATCGCGCTGGATGTGAACGGTTATATCTCTGAAGGCGCAGGCGAAAACCTGTTTGAAGTGAAAGATGGTGTGCTGTTCACCCCACCGTTCACCTCCTCCGCGCTGCCGGGTATTACCCGTGATGCCATCATCAAACTGGCGAAAGAGCTGGGAATTGAAGTACGTGAGCAGGTGCTGTCGCGCGAATCCCTGTACCTGGCGGATGAAGTGTTTATGTCCGGTACGGCGGCAGAAATCACGCCAGTGCGCAGCGTAGACGGTATTCAGGTTGGCGAAGGCCGTTGTGGCCCGGTTACCAAACGCATTCAGCAAGCCTTCTTCGGCCTCTTCACTGGCGAAACCGAAGATAAATGGGGCTGGTTAGATCAAGTTAATCAATAA

SEQ ID NO: 98 - protein, 566 aa, Streptomyces cinnamonensis
MDADAIEEGRRRWQARYDKARKRDADFTTLSGDPVDPVYGPRPGDTYDGFERIGWPGEYPFTRGLYATGYRGRTWTIRQFAGFGNAEQTNERYKMILANGGGGLSVAFDMPTLMGRDSDDPRSLGEVGHCGVAIDSAADMEVLFKDIPLGDVTTSMTISGPAVPVFCMYLVAAERQGVDPAVLNGTLQTDIFKEYIAQKEWLFQPEPHLRLIGDLMEHCARDIPAYKPLSVSGYHIREAGATAAQELAYTLADGFGYVELGLSRGLDVDVFAPGLSFFFDAHVDFFEEIAKFRAARRIWARWLRDEYGAKTEKAQWLRFHTQTAGVSLTAQQPYNNVVRTAVEALAAVLGGTNSLHTNALDETLALPSEQAAEIALRTQQVLMEETGVANVADPLGGSWYIEQLTDRIEADAEKIFEQIRERGRRACPDGQHPIGPITSGILRGIEDGWFTGEIAESAFQYQRSLEKGDKRVVGVNCLEGSVTGDLEILRVSHEVEREQVRELAGRKGRRDDARVRASLDAMLAAARDGSNMIAPMLEAVRAEATLGEICGVLRDEWGVYVEPPGF

SEQ ID NO: 99 - DNA, 4362 bp, Streptomyces cinnamonensis
tgaggcgctggatcgcctcggagagcagctggtaacggtccgcgtggtactcggccggggtgcagccgtccacgatgtgcgggatcgcgtcgggctcgaggatcaccagggcgggggcgtcgccgatcgcgtcggcgaacgtgtccacccagctccggtaggcctccgcactggccgcgccgcccgcggagtgctgaccgcagtcgcggtgcgggatgttgtacgcgacgagtacggcggtgcggtcctccttgaccgcgccccgcgtcgccttcgcgacgtcgggcgccggatcgtccccggccggccacacggccatggcccgttcggagatgcgcctgagcgtctcggcgtcctcggcgcggccctgttcctcccactgcctgacctggcgcgcggcggggctgtcggggtcgacccagaaggtgccggcggggggcccggcgctcgcggtggcgggcttgcgcacggccgcctcctccttcgtgccgtcggaccccgggtctgaggaggagcagcctgccgggagcccgagggcggcgagggccgcgagtgccgtgaacgtgcggagcagccggtgcatccagcccccttgggcgatggtgacagtgacggtcagtcagcccggcaatcgttacataaaggactattcaagctcttgtgccacaccgcctccggtgccgagcgcgaacccggcgggcaccagagccccgccgcggccgcggagccgtacgtacgaccgaattgcgagacggggctgaccaccatatgaccggcgggtaaggtcgatgccgtgccgaagccgctcagcctccccttcgatcccatcgcccgcgccgacgagctctggaagcagcgctggggatcggtcccggccatgggcgcgatcacctcgatcatgcgggcgcaccagatcctgctcgccgaggtcgacgcggtcgtcaagccgtacggactgaccttcgcgcgctacgaggcgctggtgctcctcaccttctcgcaggccggcgagttgccgatgtcgaagatcggcgagcggctcatggtgcacccgacctcggtcacgaacaccgtggaccgcctggtgaagtccggcctggtcgacaagcgcccgaaccccaacgacggccgcggcacgctcgcctccatcacggagaagggccgcgaggtcgtcgaggcggccacccgcgagctgatggcgatggacttcgggctcggggtgtacgacgcggaggagtgcggggagatcttcgcgatgctgcggcccctgcgggtggcggcgcgcgatttcgaggagcagtagggcccgcccggtgagaagtgggatcgggtcgtcccggtacgggcgggggcggcgaagatcgcgtgaaaagggcggttacgctcgtagccatgaaacgcagcgtgctgacccgctaccgggtgatggcctacgtcaccgccgtcatgctcctcatcctgtgcgcctgcatggtggccaagtacggcttcgacaagggcgagggtctgaccctcgtcgtgtcgcaggtgcacggcgtgctctacatcatctacctgatcttcgccttcgacctgggctccaaggcgaagtggccgttcggcaagctgctctgggtgctggtctcgggcacgatcccgaccgccgccttcttcgtcgagcgcaaggtcgcccgtgacgtcgagccgctgatcgccgacggctccccggtcaccgcgaaggcgtaacccgcaccgccacggacaggtccgtggcggttggccatcgacttttactaggacgtcctagtaaattcgatggtatggacgctgacgcgatcgaggaaggccgccgacgctggcaggcccgttacgacaaggcccgcaagcgcgacgcggacttcaccacgctctccggggaccccgtcgaccccgtctacggcccccggcccggggacacgtacgacgggttcgagcggatcggctggccgggggagtaccccttcacccgcgggctctacgccaccgggtaccgcggccgcacctggaccatccgccagttcgccggcttcggcaacgccgagcagacgaacgagcgctacaagatgatcctggccaacggcggcggcggcctctccgtcgccttcgacatgccgaccctcatgggccgcgactccgacgacccgcgctcgctcggcgaggtcggccactgcggtgtcgccatcgactccgccgccgacatggaggtcctcttcaaggacatcccgctcggcgacgtcacgacgtccatgaccatcagcgggcccgccgtgcccgtcttctgcatgtacctcgtcgcggccgagcgccagggcgtcgacccggccgtcctcaacggcacgctgcagaccgacatcttcaaggagtacatcgcccagaaggagtggctcttccagcccgagccgcacctgcgcctcatcggcgacctgatggagcactgcgcgcgcgacatccccgcgtacaagccgctctcggtctccggctaccacatccgcgaggccggggcgacggccgcgcaggagctcgcgtacaccctcgcggacggcttcgggtacgtggaactgggcctctcgcgcggcctggacgtggacgtcttcgcgcccggcctctccttcttcttcgacgcgcacgtcgacttcttcgaggagatcgcgaagttccgcgccgcacgccgcatctgggcgcgctggctccgggacgagtacggagcgaagaccgagaaggcacagtggctgcgcttccacacgcagaccgcgggggtctcgctcacggcccagcagccgtacaacaacgtggtgcggacggcggtggaggccctcgccgcggtgctcggcggcacgaactccctgcacaccaacgctctcgacgagacccttgccctccccagcgagcaggccgcggagatcgcgctgcgcacccagcaggtgctgatggaggagaccggcgtcgccaacgtcgcggacccgctgggcggctcctggtacatcgagcagctcaccgaccgcatcgaggccgacgccgagaagatcttcgagcagatcagggagcgggggcggcgggcctgccccgacgggcagcacccgatcgggccgatcacctccggcatcctgcgcggcatcgaggacggctggttcaccggcgagatcgccgagtccgccttccagtaccagcggtccctggagaagggcgacaagcgggtcgtcggcgtcaactgcctcgaaggctccgtcaccggcgacctggagatcctgcgcgtcagccacgaggtcgagcgcgagcaggtgcgggagcttgcggggcgcaaggggcggcgtgacgatgcgcgggtgcgggcctcgctcgacgcgatgctcgccgctgcgcgggacgggtcgaacatgattgcccccatgctggaggcggtgcgggccgaggcgaccctcggggagatctgcggggtgcttcgcgatgagtggggggtctacgtggagccgcccgggttctgagggcgcgctccctttgcctgcgggtctgctgtggctggtcgcgcagttccccgcacccctgaaagaccccggcgctttcccttcctggctcgcctcgtcgctgtctgcggggccgtgggggctggtcgcgcagttccccgcgcccctgcccgcacctgcgccccgccgcctgcatgccgcccccaccctgacgggggcgttcggggcccaccctgacgggtgcggtcggggcgtgccggggtcttttaggggcgcggggaactgcgcgagcaacccccacccacccgcaggtgcacgcggagcggcggacgccccgcagacgggggcaaaacgggcggagtgcccccgcccgccgggcggcgcgaattcgtaggtttaaggggcaggggtcagggcaggcgccgagccggtcaaccgcccccgtcccaggagaccccgtgacctcgaccggccacgcccgcaccgccgccatcgccatcggagccgccaccgccaccgtcctcggcgcgctgctggtcggcggctccggcgaggtgagtgcgagcccgccgcccgagcccaaggtccaggacgacttcgactccctcggccccgaggtgcgcgccgcgaagctctccgacgggcggacggcccactactcggacacgggcgacaaggacggcaagccggccctgttcatcggcggcaccggcacgagcgcccgcgcctcccacatgaccgacttcttccgctcgacgcgcgaggacctgggcctgcgcctcatctccgtggagcgcaacggcttcggcgacaccgcgttcgacgagaagctgggcaccgccgacttcgcgaaggacgccctcgaagtcctcgaccggctcgg

SEQ ID NO: 100 - protein, 136 aa, Streptomyces cinnamonensis
MGVAAGPIRVVVAKPGLDGHDRGAKVIARALRDAGMEVIYTGLHQTPEQVVDTAIQEDADAIGLSILSGAHNTLFARVLELLKERDAEDIKVFGGGIIPEADIAPLKEKGVAEIFTPGATTTSIVEWVRGNVRQAV

SEQ ID NO: 101 - DNA, 1643 bp, Streptomyces cinnamonensis
gtcgacctcccgtttggcgcacggaagggaggctctgtcccccgtgtgccctagggggagtcgtggtcgaggagtcggctgtgcgatggcgatcccggccaccgccctgcggtgactccgtgcccccgttgcatcgccgatgcgcggtgtcaccacgccgtgcggctgccggcgcggtggcccggcgtctcgttgcggctcccctcgcgcctggtccggatgcggagcgtgaacccctgggttacggacgggcgcgcagcgaacgtgtcccacgtgtgatttccccctcgctctccaccgcgaaactgccgcttgcgcgatgctggggataacgttcgttcacttccccggccggtgcggtgcggggtatctgtgccgggacagactttgtcggtacggatatcggtacatggaggcagtgatgggtgtggcagccgggccgatccgcgtggtggtcgccaagccggggctcgacgggcacgatcgcggggccaaggtgatcgcgcgggcgttgcgtgacgcgggtatggaggtcatctacaccgggctgcaccagacgcccgagcaggtggtggacaccgcgatccaggaggacgccgacgcgatcggcctctccatcctctccggagcgcacaacacgctgttcgcgcgcgtgttggagctcttgaaggagcgggacgcggaggacatcaaggtgtttggtggcggcatcatcccggaggcggacatcgcgccgctgaaggagaagggcgtcgcggagatcttcacgcccggggccaccaccacgtcgatcgtggagtgggttcgggggaacgtgcgacaggccgtctgaggcattccccgtcgcccgtctgccgtggtcggcgtcatatcggcggacatcgtctcggtggacgtcatggcggcggggggagttcgtcgcgtatcgccgcgcggaggcgcagggtggtgaccaggcgctggaacgcttccgaccagtagctgcccgcgccgggtgacgcgtcctccgcttcgtcggggaccgcggtgagcgcttccaggcggaccgcctcggccgggtccagacagcgttccgccaggcccatcactccgctgaagctccatgggtaactgcccgcgtcgcgcgcgatgttcagggcgtccaccacggcccggccgagagggccggcccagggcaccgcgcagacgccgagcagttggaacgcctccgacaggccgtgtgccgctatgaaccccgccacccagtccgcgcgctcggcggcaggcatggaggcgagcagtttggcccgctcggcgagggacacggcgccaggccccgccgcgtcgggtgaggcgggggcgccgagcagcgctctggaccaggcgacgtcacgctggcgtacggccgcgcggcaccatgcggcgtgcagttcgccccgccagtcgtcggccaccgggagcgccacgatctccgccggggtgcggttgccgagccggggcggccaggtggcgagcggggccgattccacgagctggccgagccaccaggagcgctcgccccggccggtggggggcttcgggacgacgccgtcccgctccatgcccgcgtcgcactcgtgcggcgcctcgacggtgagggtcggcgtgctcgatgtgtggtcgac

SEQ ID NO: 102 - protein, 566 aa, Streptomyces coelicolor
MDAHAIEEGRLRWQARYDAARKRDADFTTLSGDPVEPVYGPRPGDEYEGFERIGWPGEYPFTRGLYPTGYRGRTWTIRQFAGFGNAEQTNERYKMILRNGGGGLSVAFDMPTLMGRDSDDPRSLGEVGHCGVAIDSAADMEVLFKDIPLGDVTTSMTISGPAVPVFCMYLVAAERQGVDASVLNGTLQTDIFKEYIAQKEWLFQPEPHLRLIGDLMEYCAAGIPAYKPLSVSGYHIREAGATAAQELAYTLADGFGYVELGLSRGLDVDVFAPGLSFFFDAHLDFFEEIAKFRAARRIWARWMRDVYGARTDKAQWLRFHTQTAGVSLTAQQPYNNVVRTAVEALAAVLGGTNSLHTNALDETLALPSEQAAEIALRTQQVLMEETGVANVADPLGGSWFIEQLTDRIEADAEKIFEQIKERGLRAHPDGQHPVGPITSGLLRGIEDGWFTGEIAESAFRYQQSLEKDDKKVVGVNVHTGSVTGDLEILRVSHEVEREQVRVLGERKDARDDAAVRGALDAMLAAARSGGNMIGPMLDAVRAEATLGEICGVLRDEWGVYTEPAGF

SEQ ID NO: 103 - DNA, 1701 bp, Streptomyces coelicolor
atggacgctcatgccatagaggagggccgccttcgctggcaggcccggtacgacgcggcgcgcaagcgcgacgcggacttcaccacgctctccggagaccccgtggagccggtgtacgggccccgccccggggacgagtacgagggcttcgagcggatcggctggccgggcgagtaccccttcacccgcggcctgtatccgaccgggtaccgggggcgtacgtggaccatccggcagttcgccgggttcggcaacgccgagcagaccaacgagcgctacaagatgatcctccgcaacggcggcggcgggctctcggtcgccttcgacatgccgaccctgatgggccgcgactccgacgacccgcgctcgctgggcgaggtcgggcactgcggggtggccatcgactcggccgccgacatggaagtgctgttcaaggacatcccgctcggggacgtgacgacctccatgacgatcagcgggcccgccgtgcccgtgttctgcatgtacctcgtcgccgccgagcgccagggcgtcgacgcatccgtgctcaacggcacgctgcagaccgacatcttcaaggagtacatcgcccagaaggagtggctcttccagcccgagccccacctccggctcatcggcgacctcatggagtactgcgcggccggcatccccgcctacaagccgctctccgtctccggctaccacatccgcgaggcgggcgcgacggccgcgcaggagctggcgtacacgctcgccgacggcttcggatacgtggagctgggcctcagccgcgggctcgacgtggacgtcttcgcgcccggcctctccttcttcttcgacgcgcacctcgacttcttcgaggagatcgccaagttccgcgcggcccgcaggatctgggcccgctggatgcgcgacgtgtacggcgcgcggaccgacaaggcccagtggctgcggttccacacccagaccgccggagtctcgctcaccgcgcagcagccgtacaacaacgtcgtacgcaccgcggtggaggcgctggcggccgtgctcggcggcaccaactccctgcacaccaacgcgctcgacgagaccctcgccctgcccagcgagcaggccgccgagatcgccctgcgcacccagcaggtgctgatggaggagaccggcgtcgccaacgtcgccgacccgctgggcggttcctggttcatcgagcagctgaccgaccgcatcgaggccgacgccgagaagatcttcgagcagatcaaggagcgggggctgcgcgcccaccccgacgggcagcaccccgtcggaccgatcacctccggcctgctgcgcggcatcgaggacggctggttcaccggcgagatcgccgagtccgccttccgctaccagcagtccttggagaaggacgacaagaaggtggtcggcgtcaacgtccacaccggctccgtcaccggcgacctggagatcctgcgggtcagccacgaggtcgagcgcgagcaggtgcgggtcctgggcgagcgcaaggacgcccgggacgacgccgccgtgcgcggcgccctggacgccatgctggccgcggcccgctccggcggcaacatgatcgggccgatgctggacgcggtgcgcgcggaggcgacgctgggcgagatctgcggtgtgctgcgcgacgagtggggggtgtacacggaaccggcggggttctga

SEQ ID NO: 104 - protein, 138 aa, Streptomyces coelicolor
MGVAAGPIRVVVAKPGLDGHDRGAKVIARALRDAGMEVIYTGLHQTPEQIVDTAIQEDADAIGLSILSGAHNTLFAAVIELLRERDAADILVFGGGIIPEADIAPLKEKGVAEIFTPGATTASIVDWVRANVREPAGA

SEQ ID NO: 105 - DNA, 417 bp, Streptomyces coelicolor
atgggtgtggcagccggtccgatccgcgtggtggtggccaagccggggctcgacggccacgatcgcggggccaaggtgatcgcgagggccctgcgtgacgccggtatggaggtgatctacaccgggctccaccagacgcccgagcagatcgtcgacaccgcgatccaggaggacgccgacgcgatcgggctgtccatcctctccggtgcgcacaacacgctcttcgccgccgtgatcgagctgctccgggagcgggacgccgcggacatcctggtcttcggcggcgggatcatccccgaggcggacatcgccccgctgaaggagaagggcgtcgcggagatcttcacgcccggcgccaccacggcgtccatcgtggactgggtccgggcgaacgtgcgggagcccgcgggagcatag

SEQ ID NO: 106 - protein, 566 aa, Streptomyces avermitilis
MDADAIEEGRRRWQARYDASRKREADFTTLSGDPVEPAYGPRPGDAYEGFERIGWPGEYPFTRGLYPTGYRGRTWTIRQFAGFGNAEQTNERYKKILANGGGGLSVAFDMPTLMGRDSDDRRALGEVGHCGVAIDSAADMEVLFKDIPLGDVTTSMTISGPAVPVFCMYLVAAERQGVDPSVLNGTLQTDIFKEYIAQKEWLFQPEPHLRLIGDLMEHCASKIPAYKPLSVSGYHIREAGATAAQELAYTLADGFGYVELGLSRGLDVDVFAPGLSFFFDAHVDFFEEIAKFRAARRIWARWLRDVYGAKSEKAQWLRFHTQTAGVSLTAQQPYNNVVRTAVEALAAVLGGTNSLHTNALDETLALPSEQAAEIALRTQQVLMEETGVANVADPLGGSWYVEQLTDRIEADAEKIFEQIRERGLRAHPDGRHPIGPITSGILRGIEDGWFTGEIAESAFQYQQALEKGDKRVVGVNVHHGSVTGDLEILRVSHEVEREQVRVLGERKSGRDDTAVTAALDAMLAAARDGSNMIAPMLDAVRAEATLGEICDVLREEWGVYTEPAGF

SEQ ID NO: 107 - DNA, 1701 bp, Streptomyces avermitilis
tcagaaaccggcgggctccgtgtagaccccccactcctcccggaggacatcgcagatctcgcccagcgtggcctccgcgcggaccgcgtccagcatcggggcgatcatgttcgacccgtcgcgcgcggcggcgagcatcgcgtccagggccgcggttacggccgtgtcgtcgcgccccgacttccgctcgcccagcacccgcacctgctcgcgctccacctcgtggctgacgcgcaggatctccaggtcgcccgtcacggacccgtggtggacgttgacgccgacgacccgcttgtcgcccttctccagcgcctgctggtactggaaggccgactcggcgatctccccggtgaaccagccgtcctcgatgccgcgcaggatgccggaggtgatgggcccgatcgggtgccgcccgtccgggtgggcccgcagcccgcgctccctgatctgttcgaagatcttctcggcgtcggcctcgatccggtcggtcagctgctccacgtaccaggaaccgcccagcggatcggccacgttggcgacgcccgtctcctccatcagcacctgctgggtgcgcagggcgatctcggccgcctgctcggacggcagggcgagggtctcgtcgagggcgttggtgtgcagcgagttcgtcccgccgagcaccgcggcgagggcctccacggccgtccgtacgacgttgttgtacggctgctgcgcggtgagcgagacgcccgcggtctgggtgtggaagcgcagccactgcgccttctccgacttcgccccgtacacgtcccgcagccagcgcgcccagatgcgccgcgccgcacggaacttggcgatctcctcgaagaagtcgacgtgcgcgtcgaagaagaaggagagcccgggcgcgaacacgtccacgtccaggccgcggctcagccccagctccacgtatccgaaaccgtcggcgagggtgtacgccagctcctgggcggccgtggcaccggcctcccggatgtggtacccggagacggacagcggcttgtacgcggggatcttcgaggcgcagtgctccatcaggtcgccgatgagccgcagatggggctcgggctggaagagccactccttctgcgcgatgtactccttgaagatgtcggtctggagggtgccgttgaggacggaggggtcgacgccctgccgctcggccgcgaccaggtacatgcagaagacgggcacggcgggcccgctgatcgtcatcgacgtcgtcacgtcacccagcgggatgtccttgaacaggacctccatgtcggccgccgagtcgatcgcgaccccgcagtgcccgacctcgccgagcgcgcggcggtcgtcggagtcgcgccccatgagcgtcggcatgtcgaaggccacggacagcccaccgccgccgttggcgaggatcttcttgtagcgctcgttggtctgctcggcgttgccgaacccggcgaactgccggatggtccaggtccggccccggtagccggtcggatacagaccgcgcgtgaaggggtactcacccggccagccgatccgctcgaaaccctcgtacgcgtccccgggccggggcccgtacgccggctccacgggatcgccggagagcgtggtgaaatcggcctcgcgcttgcgtgaggcgtcgtagcgggcctgccagcgtcggcggccttcctcgatggcgtcagcgtccat

SEQ ID NO: 108 - protein, 138 aa, Streptomyces avermitilis
MGVAAGPIRVVVAKPGLDGHDRGAKVIARALRDAGMEVIYTGLHQTPEQIVGTAIQEDADAIGLSILSGAHNTLFAAVIDLLKERDAEDIKVFGGGIIPEADIAPLKEKGVAEIFTPGATTASIVEWVRANVRQPAGA

SEQ ID NO: 109 - protein, 1701 aa, Streptomyces avermitilis
TCAGAAACCGGCGGGCTCCGTGTAGACCCCCCACTCCTCCCGGAGGACATCGCAGATCTCGCCCAGCGTGGCCTCCGCGCGGACCGCGTCCAGCATCGGGGCGATCATGTTCGACCCGTCGCGCGCGGCGGCGAGCATCGCGTCCAGGGCCGCGGTTACGGCCGTGTCGTCGCGCCCCGACTTCCGCTCGCCCAGCACCCGCACCTGCTCGCGCTCCACCTCGTGGCTGACGCGCAGGATCTCCAGGTCGCCCGTCACGGACCCGTGGTGGACGTTGACGCCGACGACCCGCTTGTCGCCCTTCTCCAGCGCCTGCTGGTACTGGAAGGCCGACTCGGCGATCTCCCCGGTGAACCAGCCGTCCTCGATGCCGCGCAGGATGCCGGAGGTGATGGGCCCGATCGGGTGCCGCCCGTCCGGGTGGGCCCGCAGCCCGCGCTCCCTGATCTGTTCGAAGATCTTCTCGGCGTCGGCCTCGATCCGGTCGGTCAGCTGCTCCACGTACCAGGAACCGCCCAGCGGATCGGCCACGTTGGCGACGCCCGTCTCCTCCATCAGCACCTGCTGGGTGCGCAGGGCGATCTCGGCCGCCTGCTCGGACGGCAGGGCGAGGGTCTCGTCGAGGGCGTTGGTGTGCAGCGAGTTCGTCCCGCCGAGCACCGCGGCGAGGGCCTCCACGGCCGTCCGTACGACGTTGTTGTACGGCTGCTGCGCGGTGAGCGAGACGCCCGCGGTCTGGGTGTGGAAGCGCAGCCACTGCGCCTTCTCCGACTTCGCCCCGTACACGTCCCGCAGCCAGCGCGCCCAGATGCGCCGCGCCGCACGGAACTTGGCGATCTCCTCGAAGAAGTCGACGTGCGCGTCGAAGAAGAAGGAGAGCCCGGGCGCGAACACGTCCACGTCCAGGCCGCGGCTCAGCCCCAGCTCCACGTATCCGAAACCGTCGGCGAGGGTGTACGCCAGCTCCTGGGCGGCCGTGGCACCGGCCTCCCGGATGTGGTACCCGGAGACGGACAGCGGCTTGTACGCGGGGATCTTCGAGGCGCAGTGCTCCATCAGGTCGCCGATGAGCCGCAGATGGGGCTCGGGCTGGAAGAGCCACTCCTTCTGCGCGATGTACTCCTTGAAGATGTCGGTCTGGAGGGTGCCGTTGAGGACGGAGGGGTCGACGCCCTGCCGCTCGGCCGCGACCAGGTACATGCAGAAGACGGGCACGGCGGGCCCGCTGATCGTCATCGACGTCGTCACGTCACCCAGCGGGATGTCCTTGAACAGGACCTCCATGTCGGCCGCCGAGTCGATCGCGACCCCGCAGTGCCCGACCTCGCCGAGCGCGCGGCGGTCGTCGGAGTCGCGCCCCATGAGCGTCGGCATGTCGAAGGCCACGGACAGCCCACCGCCGCCGTTGGCGAGGATCTTCTTGTAGCGCTCGTTGGTCTGCTCGGCGTTGCCGAACCCGGCGAACTGCCGGATGGTCCAGGTCCGGCCCCGGTAGCCGGTCGGATACAGACCGCGCGTGAAGGGGTACTCACCCGGCCAGCCGATCCGCTCGAAACCCTCGTACGCGTCCCCGGGCCGGGGCCCGTACGCCGGCTCCACGGGATCGCCGGAGAGCGTGGTGAAATCGGCCTCGCGCTTGCGTGAGGCGTCGTAGCGGGCCTGCCAGCGTCGGCGGCCTTCCTCGATGGCGTCAGCGTCCAT

SEQ ID NO: 110 - protein, 139 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMI

SEQ ID NO: 111 - DNA, 1689 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaa

SEQ ID NO: 112 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 113 - DNA, 1689 bp, Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaa

SEQ ID NO: 114 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 115 - DNA, 1599 bp, Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 116 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 117 - DNA, 1692 bp, Candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 118 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 119 - DNA, 1788 bp, Pichia stipitis
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 120 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 121 - DNA, 1707 bp, Pichia stipitis
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 122 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 123 - DNA, 1689 bp, Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaac

SEQ ID NO: 124 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 125 - DNA, 1713 bp, Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtt

SEQ ID NO: 126 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 127 - DNA, 1713 bp, Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaa

SEQ ID NO: 128 - protein, 563 aa, Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 129 - DNA, 1689 bp, Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 130 - DNA, 804 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 131 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 132 - DNA, 4582 bp, Artificial Sequence
  Plasmid pLA54
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgagccataccaaacgacgagcgtgacaccacgatgcctgtagcaatggcaacaacgttgcgcaaactattactggcgaactacttactctagcttcccggcaacaattaatagactggatggaggcggataaagttgcaggaccacttctgcgctcggcccttccggctggctggtttattgctgataaatctggagccggtgagcgtggtctcgcggtatcattgcagcactggggccagatggtaagccctcccgtatcgtagttatctacacgacgggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 133 - DNA, 80 bp, Artificial Sequence
  BK505 primer
ttccggtttctttgaaatttttttgattcggtaatctccgagcagaaggagcattgcggattacgtattctaatgttcag

SEQ ID NO: 134 - DNA, 81 bp, Artificial Sequence
  BK506 primer
gggtaataactgatataattaaattgaagctctaatttgtgagtttagtacaccttggctaactcgttgtatcatcactgg

SEQ ID NO: 135 - DNA, 38 bp, Artificial Sequence
  LA468 primer
gcctcgagttttaatgttacttctcttgcagttaggga

SEQ ID NO: 136 - DNA, 31 bp, Artificial Sequence
  LA492 primer
gctaaattcgagtgaaacacaggaagaccag

SEQ ID NO: 137 - DNA, 24 bp, Artificial Sequence
  oBP452 primer
ttctcgacgtgggcctttttcttg

SEQ ID NO: 138 - DNA, 49 bp, Artificial Sequence
  oBP453 primer
tgcagctttaaataatcggtgtcactactttgccttcgtttatcttgcc

SEQ ID NO: 139 - DNA, 49 bp, Artificial Sequence
  oBP454 primer
gagcaggcaagataaacgaaggcaaagtagtgacaccgattatttaaag

SEQ ID NO: 140 - DNA, 49 bp, Artificial Sequence
  oBP455 primer
tatggaccctgaaaccacagccacattgtaaccaccacgacggttgttg

SEQ ID NO: 141 - DNA, 49 bp, Artificial Sequence
  oBP456 primer
tttagcaacaaccgtcgtggtggttacaatgtggctgtggtttcagggt

SEQ ID NO: 142 - DNA, 49 bp, Artificial Sequence
  oBP457 primer
ccagaaaccctatacctgtgtggacgtaaggccatgaagctttttcttt

SEQ ID NO: 143 - DNA, 49 bp, Artificial Sequence
  oBP458 primer
attggaaagaaaaagcttcatggccttacgtccacacaggtatagggtt

SEQ ID NO: 144 - DNA, 22 bp, Artificial Sequence
  oBP459 primer
cataagaacacctttggtggag

SEQ ID NO: 145 - DNA, 22 bp, Artificial Sequence
  oBP460 primer
aggattatcattcataagtttc

SEQ ID NO: 146 - DNA, 23 bp, Artificial Sequence
  oBP461 primer
ttcttggagctgggacatgtttg

SEQ ID NO: 147 - DNA, 7555 bp, Artificial Sequence
  pRS423: : Gal1-cre plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtc

SEQ ID NO: 148 - DNA, 22 bp, Artificial Sequence
  Primer
tgatgatatttcataaataatg

SEQ ID NO: 149 - DNA, 23 bp, Artificial Sequence
  oBP451 primer
atgcgtccatctttacagtcctg

SEQ ID NO: 150 - DNA, 4242 bp, Artificial Sequence
  pLA59 plasmid
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcaatgcggatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 151 - DNA, 80 bp, Artificial Sequence
  PDE1F URA3 primer
atggttgtattcgaaataactatacttggggccaatggaggacccaccgatcaattcatcattttttttttattcttttt

SEQ ID NO: 152 - DNA, 80 bp, Artificial Sequence
  PDE1R URA3 primer
ttatagaaacaaagtgtggccttctagcgcaatagatattctcaagtctcggtaataactgatataattaaattgaagct

SEQ ID NO: 153 - DNA, 23 bp, Artificial Sequence
  URA IR primer
ctccagtaattccttggtggtac

SEQ ID NO: 154 - DNA, 23 bp, Artificial Sequence
  PDE1F primer
cggtttcacaaatgactcgcctg

SEQ ID NO: 155 - DNA, 23 bp, Artificial Sequence
  URA 1F primer
ctgttgacattgcgaagagcgac

SEQ ID NO: 156 - DNA, 24 bp, Artificial Sequence
  PDE1R primer
cgtacctccaatgctggaaccctc

SEQ ID NO: 157 - DNA, 12518 bp, Artificial Sequence
  pK9D3.OLE1p.IlvD plasmid
ttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgctttgttgtaatgttttagtgctgtttataatatgatcaccacaactatctattactatgatgttctattctacgtaatacaaaatataaacggaaacagaagtaggaaagatggaaatagaacaataaatgaatcaagatctgcccccatatatatatgtatatgctgatttgcaagactcgatgagccaggagccgatgatttgctgcatatattgttaactactattatttccacctttgtgtgccatccccatagccgtaacaatagggataggtgtgtctgagtgagcaagactcgtagaagcacacctggttgggcactagataaggtttgttgagtgttcaacgtccgaaagaaagctgccgactatgcgaagagaaccttaagccgttattacctctgcctgtcacaggcgatgtgatgctaacgaacagcaccagagccaagccaactggggcggtctgcagagaaggctgggatacccgaaatagctcgctcaacagctttttttcttctacggaagcccaccagataagcgcctttgttgggcccgctaaccccgggacatgcccgggctcggagttagtttttgcacggccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatcc

SEQ ID NO: 158 - DNA, 7821 bp, Artificial Sequence
  pWZ009 plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaagtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaacggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatgtgtgcgtgtatgtgtacacctgtatttaatttccttactcgcgggtttttcttttttctcaattcttggcttcctctttctcgagcggaccggatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgccgaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 159 - DNA, 8148 bp, Artificial Sequence
  pWZ001 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcatactagcgttgaatgttagcgtcaacaacaagaagtttaatgacgcggaggccaaggcaaaaagattccttgattacgtaagggagttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 160 - DNA, 4236 bp, Artificial Sequence
  pLA33 plasmid
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 161 - DNA, 80 bp, Artificial Sequence
  Primer 315
cttcgaagaatatactaaaaaatgagcaggcaagataaacgaaggcaaaggcattgcggattacgtattctaatgttcag

SEQ ID NO: 162 - DNA, 81 bp, Artificial Sequence
  Primer 316
tatacacatgtatatatatcgtatgctgcagctttaaataatcggtgtcacaccttggctaactcgttgtatcatcactgg

SEQ ID NO: 163 - DNA, 22 bp, Artificial Sequence
  Primer 92
gagaagatgcggccagcaaaac

SEQ ID NO: 164 - DNA, 25 bp, Artificial Sequence
  Primer 346
ggaataccacttgccacctatcacc

SEQ ID NO: 165 - DNA, 22 bp, Artificial Sequence
  oBP440 primer
tacgtacggaccaatcgaagtg

SEQ ID NO: 166 - DNA, 49 bp, Artificial Sequence
  oBP441 primer
aattcgtttgagtacactactaatggctttgttggcaatatgtttttgc

SEQ ID NO: 167 - DNA, 49 bp, Artificial Sequence
  oBP442 primer
atatagcaaaaacatattgccaacaaagccattagtagtgtactcaaac

SEQ ID NO: 168 - DNA, 49 bp, Artificial Sequence
  oBP443 primer
tatggaccctgaaaccacagccacattcttgttatttataaaaagacac

SEQ ID NO: 169 - DNA, 49 bp, Artificial Sequence
  oBP444 primer
ctcccgtgtctttttataaataacaagaatgtggctgtggtttcagggt

SEQ ID NO: 170 - DNA, 49 bp, Artificial Sequence
  oBP445 primer
taccgtaggcgtccttaggaaagatagaaggccatgaagctttttcttt

SEQ ID NO: 171 - DNA, 49 bp, Artificial Sequence
  oBP446 primer
attggaaagaaaaagcttcatggccttctatctttcctaaggacgccta

SEQ ID NO: 172 - DNA, 21 bp, Artificial Sequence
  oBP447 primer
ttattgtttggcatttgtagc

SEQ ID NO: 173 - DNA, 22 bp, Artificial Sequence
  oBP448 primer
ccaagcatctcataaacctatg

SEQ ID NO: 174 - DNA, 22 bp, Artificial Sequence
  oBP449 primer
tgtgcagatgcagatgtgagac

SEQ ID NO: 175 - DNA, 17 bp, Artificial Sequence
  oBP554 primer
agttattgataccgtac

SEQ ID NO: 176 - DNA, 19 bp, Artificial Sequence
  oBP555 primer
cgagataccgtaggcgtcc

SEQ ID NO: 177 - DNA, 24 bp, Artificial Sequence
  oBP513 primer
ttatgtatgctcttctgacttttc

SEQ ID NO: 178 - DNA, 49 bp, Artificial Sequence
  oBP515 primer
aataattagagattaaatcgctcattttttgccagtttcttcaggcttc

SEQ ID NO: 179 - DNA, 49 bp, Artificial Sequence
  oBP516 primer
agcctgaagaaactggcaaaaaatgagcgatttaatctctaattattag

SEQ ID NO: 180 - DNA, 49 bp, Artificial Sequence
  oBP517 primer
tatggaccctgaaaccacagccacatttttcaatcattggagcaatcat

SEQ ID NO: 181 - DNA, 49 bp, Artificial Sequence
  oBP518 primer
taaaatgattgctccaatgattgaaaaatgtggctgtggtttcagggtc

SEQ ID NO: 182 - DNA, 49 bp, Artificial Sequence
  oBP519 primer
accgtaggtgttgtttgggaaagtggaaggccatgaagctttttctttc

SEQ ID NO: 183 - DNA, 49 bp, Artificial Sequence
  oBP520 primer
ttggaaagaaaaagcttcatggccttccactttcccaaacaacacctac

SEQ ID NO: 184 - DNA, 23 bp, Artificial Sequence
  oBP521 primer
ttattgcttagcgttggtagcag

SEQ ID NO: 185 - DNA, 21 bp, Artificial Sequence
  oBP511 primer
tttttggtggttccggcttcc

SEQ ID NO: 186 - DNA, 22 bp, Artificial Sequence
  oBP512 primer
aaagttggcatagcggaaactt

SEQ ID NO: 187 - DNA, 16 bp, Artificial Sequence
  oBP550 primer
gtcattgacaccatct

SEQ ID NO: 188 - DNA, 19 bp, Artificial Sequence
  oBP551 primer
agagataccgtaggtgttg

SEQ ID NO: 189 - DNA, 28 bp, Artificial Sequence
  ilvDSm(1354F) primer
ggaccaaagggcggtcctggtatgcctg

SEQ ID NO: 190 - DNA, 26 bp, Artificial Sequence
  ilvDSm(788R) primer
gcttcacgcgttaaaatgtcagaagg

SEQ ID NO: 191 - DNA, 23 bp, Artificial Sequence
  MAT1 primer
agtcacatcaagatcgtttatgg

SEQ ID NO: 192 - DNA, 23 bp, Artificial Sequence
  MAT2 primer
gcacggaatatgggcatacttcg

SEQ ID NO: 193 - DNA, 23 bp, Artificial Sequence
  MAT3 primer
actccacttcaagtaagagtttg

SEQ ID NO: 194 - DNA, 29 bp, Artificial Sequence
  T-A(PDC5) primer
ctgtcgctaacacctgtatggttgcaacc

SEQ ID NO: 195 - DNA, 48 bp, Artificial Sequence
  B-A(kivD) primer
gatagtcacctactgtatacattttgttcttcttgttattgtattgtg

SEQ ID NO: 196 - DNA, 15539 bp, Artificial Sequence
  pLH468 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 197 - DNA, 57 bp, Artificial Sequence
  T-kivD(A) primer
acacaatacaataacaagaagaacaaaatgtatacagtaggtgactatctgttggac

SEQ ID NO: 198 - DNA, 56 bp, Artificial Sequence
  B-kivD(B) primer
tcaggcagcgcctgcgttcgagtcagctcttgttttgttctgcaaataacttaccc

SEQ ID NO: 199 - DNA, 5231 bp, Artificial Sequence
  pUC19-URA3-sadB-PDC5fragmentB plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 200 - DNA, 47 bp, Artificial Sequence
  T-B(kivD) primer
atttgcagaacaaaacaagagctgactcgaacgcaggcgctgcctga

SEQ ID NO: 201 - DNA, 49 bp, Artificial Sequence
  oBP546 primer
agcgtatacatctgttgggaaagtagaaggccatgaagctttttctttc

SEQ ID NO: 202 - DNA, 49 bp, Artificial Sequence
  oBP547 primer
ttggaaagaaaaagcttcatggccttctactttcccaacagatgtatac

SEQ ID NO: 203 - DNA, 22 bp, Artificial Sequence
  oBP539 primer
ttattgtttagcgttagtagcg

SEQ ID NO: 204 - DNA, 21 bp, Artificial Sequence
  oBP540 primer
taggcataatcaccgaagaag

SEQ ID NO: 205 - DNA, 29 bp, Artificial Sequence
  kivD(652R) primer
ctgagtaacagtcttctctaggccgaacg

SEQ ID NO: 206 - DNA, 17 bp, Artificial Sequence
  oBP552 primer
agttgttagaactgttg

SEQ ID NO: 207 - DNA, 19 bp, Artificial Sequence
  oBP553 primer
gacgatagcgtatacatct

SEQ ID NO: 208 - DNA, 29 bp, Artificial Sequence
  kivD(602F) primer
caagagattctgaacaaaatacaggaaag

SEQ ID NO: 209 - DNA, 27 bp, Artificial Sequence
  kivD(1250F) primer
ccccgcagctctaggcagccaaattgc

SEQ ID NO: 210 - DNA, 9093 bp, Artificial Sequence
  pRS423-TPI1p-ilvD(y) plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgaccctacgttagtgtgagcgggatttaaactgtgaggaccttaatacattcagacacttctgcggtatcaccctacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaactagtatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatactccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtca

SEQ ID NO: 211 - DNA, 4905 bp, Artificial Sequence
  pMOD-URA3r2 plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgacagctgtctcttatacacatctcaaccatcatcgatgaattttctcgggtgttctcgcatattggctcgaattcgcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtgcggccgcgaattcgagctcggtacccggggatcctctagagtcgacctgcaggcatgcaagcttgccaacgactacgcactagccaacaagagcttcagggttgagatgtgtataagagacagctgtcttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 212 - DNA, 56 bp, Artificial Sequence
  T-TEF1t(NotI) primer
ctaaagctatgtgcggccgcgtttaacttgatactactagattttttctcttcatt

SEQ ID NO: 213 - DNA, 52 bp, Artificial Sequence
  B-TEF1t(NotI) primer
ttacttatatggcggccgcgaacagagaaactaaatccacattaattgagag

SEQ ID NO: 214 - DNA, 60 bp, Artificial Sequence
  T-DSmo(RPS5p) primer
gagactagaaataaccgaccattccaaaatgaccgataaaaagactttgaaggatttgag

SEQ ID NO: 215 - DNA, 725 bp, Artificial Sequence
  UAS(PGK1)-FBA1p promoter
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 216 - DNA, 8366 bp, Artificial Sequence
  pRS316-UAS(PGK1)-FBA1p-GUS plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 217 - DNA, 49 bp, Artificial Sequence
  T-U/PGK1 (XhoApa)  primer
actacagatctcgaggggcccaattaccgtcgctcgtgatttgtttgca

SEQ ID NO: 218 - DNA, 49 bp, Artificial Sequence
  B-FBA1(SpeI) primer
gtatcaaatactagtttgaatatgtattacttggttatggttatatatg

SEQ ID NO: 219 - DNA, 7639 bp, Artificial Sequence
  pMOD-URA3r2-UAS(PGK1)-FBA1p-ilvD(y)-TEF1t  plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgacagctgtctcttatacacatctcaaccatcatcgatgaattttctcgggtgttctcgcatattggctcgaattcgcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtgcggccgccgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattgggcccctcgacctgcaggcatgcaagcttgccaacgactacgcactagccaacaagagcttcagggttgagatgtgtataagagacagctgtcttaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 220 - DNA, 77 bp, Artificial Sequence
  T-FRA(Dsm) primer
tcctaacaactcagtggagagaaacaaagcgccaacgacactataagatgcccgtaattaccgtcgctcgtgatttg

SEQ ID NO: 221 - DNA, 81 bp, Artificial Sequence
  B-FRA(Dsm)  primer
aaagattcaatgccgtctcctttcgaaacttaataatagaacaatatcatcctttcgcattgcggattacgtattctaatg

SEQ ID NO: 222 - DNA, 21 bp, Artificial Sequence
  oBP602 primer
tgttcaaacccctaaccaacc

SEQ ID NO: 223 - DNA, 27 bp, Artificial Sequence
  DSm(o)50R primer
ctgtttggggacttaaccattgaatcg

SEQ ID NO: 224 - DNA, 32 bp, Artificial Sequence
  DSm(o)1F primer
atgaccgataaaaagactttgaaggatttgag

SEQ ID NO: 225 - DNA, 26 bp, Artificial Sequence
  DSm(o)688F primer
gccaggttccagttctcatcctgctg

SEQ ID NO: 226 - DNA, 29 bp, Artificial Sequence
  DSm(o)1352F primer
gttggtcctaaaggtggtccaggtatgcc

SEQ ID NO: 227 - DNA, 85 bp, Artificial Sequence
  T-URA(gpd_60bp) primer
gtattttggtagattcaattctctttccctttccttttccttcgctccccttctttatcagcattgcggattacgtattctaatg

SEQ ID NO: 228 - DNA, 55 bp, Artificial Sequence
  B-URA(alsS) primer
cagtattgttattcatttcagatccaccttggctaactcgttgtatcatcactgg

SEQ ID NO: 229 - DNA, 7589 bp, Artificial Sequence
  pUC19-kan::pdc1::FBA-alsS::TRX1 plasmid
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 230 - DNA, 48 bp, Artificial Sequence
  T-alsS(URA) primer
tgatacaacgagttagccaaggtggatctgaaatgaataacaatactg

SEQ ID NO: 231 - DNA, 89 bp, Artificial Sequence
  B-alsS(gpd_60bp) primer
attggttgggggaaaaagaggcaacaggaaagatcagagggggagggggagggggggtgtctagagagctttcgttttcatgagttccc

SEQ ID NO: 232 - DNA, 23 bp, Artificial Sequence
  FBA-als1557 primer
ccgaaattctggaatatcaatgg

SEQ ID NO: 233 - DNA, 24 bp, Artificial Sequence
  gpd2-down178 primer
cgataatagcgtgtataatggtag

SEQ ID NO: 234 - DNA, 33 bp, Artificial Sequence
  gpd2-up229 primer
gttcagcagctcttctctaccctgtcattctag

SEQ ID NO: 235 - DNA, 27 bp, Artificial Sequence
  FBA-als752 primer
gcttagtggagcaaggtgtcacacatg

SEQ ID NO: 236 - DNA, 10679 bp, Artificial Sequence
  pBP1339 (=pA-UAS(PGK1)-ENO2p-ilvD-TEF1t-ILV5p-adh-B-U-C) plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgcgatcgcaaagactacgagaatcaataaacgaggctaaactgcgtcacacatgattgtgattgagtactcacgttctcgtgttaatcccgcggtcttcttgttttactaacttttctttctctcatagcattctcttgacagtgttttatatacatcatatgtacatttatcgagccaatcgagggcagcagtttaacatcaagccggatttgctcacgctactttgaccccttttcgtttcgacggagagaagaaaccggtgttttcctatccttgcctattctttcctccttacggggtcctagcctgtttctcttgatatgataataggtggaaacgtagaaaaaaaaatcgacatataaaagtggggcagatacttcgtgtgacaatggccaattcaagccctttgggcagatgttgcccttcttctttcttaaaaagtcttagtacgattgaccaagtcagaaaaaaaaaaaaaaaggaactaaaaaaagttttaattaattatttaaatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactagtattattgtatgttatagtattagttgcttggtgttatgaaagaaactaagaaaagaaaaataaaataaaaataaaagattgagacaagggaagaaaagatacaaaataagaattaattacaattgcgtttgctataaatacgtttttaacaatcaactctggtaggaagataatgctttttttttttatatatgcttggtgccacttgtcacatacaattctacaaccttcgacaaaaatccaaatgatagtaagatcaaagccagaaagcaatggagaaaaaaaattaatgaaccacgatgaaccaaatgatcaatacaaccaaagaaactaccctagtgaggtgtatgctgacttggtatcacacttcatgaattttgcatatggcaaagtccacgaaagtgggcttcagaaaaaaggcgtgcggtgtgtagatgtatcaattagtggatgccagttttggaacgggattccactttccgcaagttggtgcacgtcgttagtgacataacgccgcgtcgacaggaccttgttgtgtgacgaaattggaagctgcaatcaataggaagacaggaagtcgagcgtgtctgggttttttcagttttgttctttttgcaaacaaatcacgagcgacggtaattggcgcgccacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgtttaaactgacaaaataatatttggggcccctcgcggctcatttgtagtatctaagattatgtattttcttttataatatttgttgttatgaaacagacagaagtaagtttctgcgactatattatttttttttttcttctttttttttcctttattcaacttggcgatgagctgaaaatttttttggttaaggaccctttagaagtattgaatgtgggaacaaagacgacaaaaggtagttttttccttgactatactggtaagatatcgtctaaaacaaagcatggccaagaaaatatcaaagaattcaagagctgctagacaatcggatgctcttgaaccagaggtaaaggatttaagtgaactacctagagctgaaaaaaccgatttgactaatattttgattagaacagcagccaagaatgaggcattgctggaagcaaagatatctaagaaagccaataaaagtaagaggggcaagaagttaaataaaaaggctctggaagggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagccttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaagtaattaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 237 - DNA, 40 bp, Artificial Sequence
  oBP685 primer
aattggatccgcgatcgcaaagactacgagaatcaataaa

SEQ ID NO: 238 - DNA, 34 bp, Artificial Sequence
  oBP690 primer
aattttaattaattacttcatttcaccgtgattg

SEQ ID NO: 239 - DNA, 22 bp, Artificial Sequence
  oBP726 primer
atcaagattattctgactccaa

SEQ ID NO: 240 - DNA, 33 bp, Artificial Sequence
  DSm1354F primer
cgggttcatcttctcacccggctgaatccgcag

SEQ ID NO: 241 - DNA, 26 bp, Artificial Sequence
  DSm788R primer
gcttcacgcgttaaaatgtcagaagg

SEQ ID NO: 242 - DNA, 33 bp, Artificial Sequence; identical to SEQ ID NO: 240
  DSm696F primer

SEQ ID NO: 243 - DNA, 26 bp, Artificial Sequence
  ADHBi643R primer
cggctgcggcgttaccacccgtggag

SEQ ID NO: 244 - DNA, 26 bp, Artificial Sequence
  ADHBi554F primer
cccgttggtttggccgccttactgac

SEQ ID NO: 245 - DNA, 23 bp, Artificial Sequence
  N1251 primer
ccaatgtggctgtggtttcaggg

SEQ ID NO: 246 - DNA, 26 bp, Artificial Sequence
  N1252 primer
gcaaggccatgaagctttttctttcc

SEQ ID NO: 247 - DNA, 57 bp, Artificial Sequence
  N1253 primer
gaaaaagcttcatggccttgcgctcatcaacactaaaattagagtcattctaattgc

SEQ ID NO: 248 - DNA, 29 bp, Artificial Sequence
  N1254 primer
ttatccacggaagatatgatgaggtgacg

SEQ ID NO: 249 - DNA, 29 bp, Artificial Sequence
  N1256 primer
acctagctaaactaagtaaatctgtatac

SEQ ID NO: 250 - DNA, 64 bp, Artificial Sequence
  N1255 primer
ggaccctgaaaccacagccacattggtaccttccttgccaaagggattaaacctgacaattacc

SEQ ID NO: 251 - DNA, 29 bp, Artificial Sequence
  N1257 primer
gatgatgctatttggtgcagagggtgatg

SEQ ID NO: 252 - DNA, 60 bp, Artificial Sequence
  N1258 primer
cagatttacttagtttagctaggtgtatcaaaatacgttctcaatgttctatttcccgcc

SEQ ID NO: 253 - DNA, 28 bp, Artificial Sequence
  N1249 primer
gctttatggaccctgaaaccacagccac

SEQ ID NO: 254 - DNA, 25 bp, Artificial Sequence
  N1239 primer
gacgaggataatgtgcatgaacggg

SEQ ID NO: 255 - DNA, 27 bp, Artificial Sequence
  N1250 primer
ggaaagaaaaagcttcatggccttgcg

SEQ ID NO: 256 - DNA, 24 bp, Artificial Sequence
  N1242 primer
gtttcgttgcgttggtggaatggc

SEQ ID NO: 257 - DNA, 44 bp, Artificial Sequence
  B-A(kivDLg) primer
ctgtcctacggtatacattttgttcttcttgttattgtattgtg

SEQ ID NO: 258 - DNA, 8289 bp, Artificial Sequence
  pBP1719 (= pUC19-ura3MCS-U(PGK1)Pfbai-kivD Lg(y)-ADH1 BAC-kivD.LI fragment C plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactatctcatatacaggcgcgccaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaagtttaaactaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacggatccacagcctagccttcagttgggctctatcttcatcgtcattcattgcatctactagccccttacctgagcttcaagacgttatatcgcttttatgtatcatgatcttatcttgagatatgaatacataaatatatttactcaagtgtatacgtgcatgctttttttggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcgtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagctgattaattaagtctaggttctttggctgttcaatacgccaaggctatgggttacagagtcttgggtattgacggtggtgaaggtaaggaagaattattcagatccatcggtggtgaagtcttcattgacttcactaaggaaaaggacattgtcggtgctgttctaaaggccactgacggtggtgctcacggtgtcatcaacgtttccgtttccgaagccgctattgaagcttctaccagatacgttagagctaacggtaccaccgttttggtcggtatgccagctggtgccaagtgttgttctgatgtcttcaaccaagtcgtcaagtccatctctattgttggttcttacgtcggtaacagagctgacaccagagaagctttggacttcttcgccagaggtttggtcaagtctccaatcaaggttgtcggcttgtctaccttgccagaaatttacgaaaagatggaaaagggtcaaatcgttggtagatacgttgttgacacttctaaagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 259 - DNA, 52 bp, Artificial Sequence
  T-kivDLg(A) primer
acacaatacaataacaagaagaacaaaatgtataccgtaggacagtacttgg

SEQ ID NO: 260 - DNA, 52 bp, Artificial Sequence
  B-kivDLg(B) primer
tcaggcagcgcctgcgttcgagttaagagttttgcttagataaggctaagcc

SEQ ID NO: 261 - DNA, 5231 bp, Artificial Sequence; identical to SEQ ID NO: 199
  pBP904 (= pUC19-URA3-sadB-PDC5fragmentB) plasmid

SEQ ID NO: 262 - DNA, 43 bp, Artificial Sequence
  T-B(kivDLg) primer
ttatctaagcaaaactcttaactcgaacgcaggcgctgcctga

SEQ ID NO: 263 - DNA, 44 bp, Artificial Sequence
  oBP546(new) primer
gtatcctatagatccccacaaaaggccatgaagctttttctttc

SEQ ID NO: 264 - DNA, 49 bp, Artificial Sequence
  oBP547(new) primer
aagaaaaagcttcatggccttttgtggggatctataggatacactttcc

SEQ ID NO: 265 - DNA, 28 bp, Artificial Sequence
  oBP539(new) primer
tcagctcttgttttgttctgcaaataac

SEQ ID NO: 266 - DNA, 31 bp, Artificial Sequence
  kivDLg(569R) primer
gtgtgatagtatgatttctgcaagttgtgcc

SEQ ID NO: 267 - DNA, 26 bp, Artificial Sequence
  kivDLg(530F) primer
gctcataaagcaatagttaaacctgc

SEQ ID NO: 268 - DNA, 29 bp, Artificial Sequence
  kivDLg(1162F) primer
ggggacatcatctttcggtttgatgttgg

SEQ ID NO: 269 - DNA, 28 bp, Artificial Sequence
  T-HIS3(up300)
ttggtgagcgctaggagtcactgccagg

SEQ ID NO: 270 - DNA, 28 bp, Artificial Sequence
  B-HIS3(down273) primer
cggaataccacttgccacctatcaccac

SEQ ID NO: 271 - DNA, 10528 bp, Artificial Sequence
  pNZ001 plasmid
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaagtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatgtgtgcgtgtatgtgtacacctgtatttaatttccttactcgcgggtttttcttttttctcaattcttggcttcctctttctcgagcggaccggaattaccgtcgctcgtgatttgtttgcaaaaagaacaaaactgaaaaaacccagacacgctcgacttcctgtcttcctattgattgcagcttccaatttcgtcacacaacaaggtcctgtcgacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataatacacgtgagtagtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgccgaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 272 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

What is claimed is:

1. A process for producing isobutanol comprising:
(a) providing a recombinant yeast host cell comprising an engineered isobutanol biosynthetic pathway, wherein the engineered isobutanol biosynthetic pathway comprises polynucleotides encoding polypeptides that catalyze the substrate to product conversion of (i) pyruvate to acetolactate, (ii) acetolactate to 2,3-dihydroxyisovalerate, (iii) 2,3-dihydroxyisovalerate to 2-ketoisovalerate, (iv) 2-ketoisovalerate to isobutyraldehyde, and (v) isobutyraldehyde to isobutanol,
(b) contacting the recombinant yeast host cell with a fermentation medium comprising one or more carbon substrates under conditions wherein isobutanol is produced;
(c) collecting the recombinant yeast host cell;
(d) recovering isobutanol from the fermentation medium;
(e) contacting the collected recombinant yeast host cell of (c) with one or more carbon substrates under conditions wherein isobutanol is produced;
(f) repeating steps (c)-(e); and, optionally exposing the collected recombinant yeast host cell of (c) to conditions of pH less than or equal to about 3.0 in the presence of at least about 0.3% isobutanol.

2. The process of claim 1, wherein steps c)-e) are repeated at least ten times.

3. The process of claim 1, wherein the recombinant yeast host cell does not express or has reduced expression of pyruvate decarboxylase.

4. The process of claim 1, wherein the recombinant yeast host cell does not express or has reduced expression of glyceraldehyde-3-phosphate dehydrogenase.

5. The process of claim 1, wherein the recombinant yeast host cell does not express or has reduced expression of phosphodiesterase.

6. The process of claim 5, wherein the phosphodiesterase is PDE1.

7. The process of claim 1, wherein the recombinant yeast host cell does not express or has reduced expression of butanediol dehydrogenase (BDH1).

8. The process of claim 1, wherein the recombinant yeast host cell is present at a cell density of at least about 2 gdcw/L during the contacting of (b).

9. The process of claim 1, wherein the recombinant yeast host cell of (b) maintains its specific productivity for at least ten cycles of repeating steps (c)-(e).

10. The process of claim 1, wherein isobutanol is produced in (b) at an effective rate of at least about 0.1 g/gdcw/h.

11. The process of claim 1, wherein the contacting of (b) occurs in the presence of an extractant.

12. The process of claim 1, wherein the contacting of (b) and (e) occur under anaerobic or microaerobic conditions.

13. The process of claim 3 wherein the recombinant yeast host cell does not express or has reduced expression of a gene encoding acetolactate reductase.

14. The process of claim 13 wherein the reduction in expression is the result of an insertion, mutation, substitution, and/or deletion of a gene encoding YMR226C.

15. The process of claim 1, wherein the substrate to product conversion of pyruvate to acetolactate is catalyzed by acetolactate synthase, the substrate to product conversion of acetolactate to 2,3-dihydroxyisovalerate is catalyzed by acetohydroxy acid reductoisomerase, the substrate to product conversion of 2,3-dihydroxyisovalerate to 2-ketoisovalerate is catalyzed by acetohydroxy acid dehydratase, the substrate to product conversion of 2-ketoisovalerate to isobutyraldehyde is catalyzed by a branched-chain α-keto acid decarboxylase, and the substrate to product conversion of isobutyraldehyde to isobutanol is catalyzed by a branched-chain alcohol dehydrogenase.

16. The process of claim 1, wherein the recombinant yeast host cell comprises at least one deletion, mutation, and/or substitution in an endogenous gene encoding a polypeptide affecting Fe—S cluster biosynthesis, wherein the polypeptide affecting Fe—S cluster biosynthesis is selected from AFT1, AFT2, FRA2, GRX3, or CCC1.

17. The process of claim 1, wherein the recombinant yeast host cell comprises a deletion, mutation, and/or substitution in an endogenous gene encoding one or more polypeptides selected from pyruvate decarboxylase, glyceraldehyde-3-phosphate dehydrogenase, AFT1, AFT2, FRA2, GRX3, and CCC1.

18. The process of claim 1, wherein the isobutanol is recovered by distillation, liquid-liquid extraction, decantation, adsorption, gas stripping, membrane evaporation, pervaporation, or combinations thereof.

19. The process of claim 1, wherein solids may be removed from the fermentation medium by centrifugation, filtration, decantation, or combinations thereof.

20. The process of claim 11, wherein the extractant is selected from the group consisting of $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof.

21. The process of claim 11, wherein the extractant is selected from the group consisting of oleyl alcohol, behenyl alcohol, cetyl alcohol, lauryl alcohol, myristyl alcohol, stearyl alcohol, alkyl alkanols, 1-undecanol, oleic acid, lauric acid, myristic acid, stearic acid, methyl myristate, methyl oleate, undecanal, lauric aldehyde, 20-methylundecanal, trioctyl phosphine oxide, and mixtures thereof.

* * * * *